United States Patent
Stryer et al.

(10) Patent No.: US 7,374,878 B2
(45) Date of Patent: May 20, 2008

(54) RECEPTOR FINGERPRINTING, SENSORY PERCEPTION, AND BIOSENSORS OF CHEMICAL SENSANTS

(75) Inventors: Lubert Stryer, Stanford, CA (US); Sergey Zozulya, San Diego, CA (US)

(73) Assignee: Senomyx, Inc., San Diego, CA (US)

( * ) Notice: Subject to any disclaimer, the term of this patent is extended or adjusted under 35 U.S.C. 154(b) by 1295 days.

(21) Appl. No.: 09/886,055

(22) Filed: Jun. 22, 2001

(65) Prior Publication Data

US 2002/0132273 A1    Sep. 19, 2002

Related U.S. Application Data

(60) Provisional application No. 60/213,812, filed on Jun. 22, 2000.

(51) Int. Cl.
*C12Q 1/68*    (2006.01)
(52) U.S. Cl. .......................... 435/6; 435/7.1
(58) Field of Classification Search ........... 435/91.2, 435/91.21; 536/24.3
See application file for complete search history.

(56) References Cited

U.S. PATENT DOCUMENTS

2004/0224314 A1*   11/2004   Burford et al. ............ 435/6

OTHER PUBLICATIONS

Krautwurst et al. Identification of ligands for olfactory receptors by functional expression of a receptor library. Cell vol. 95:917-926. 1998.*

* cited by examiner

*Primary Examiner*—Gary Benzion
*Assistant Examiner*—Heather G. Calamita
(74) *Attorney, Agent, or Firm*—Hunton & Williams LLP

(57) ABSTRACT

The use of sensory G protein-coupled receptors that recognize chemical sensants, parti-cularly those involving olfactory and taste receptors; polypeptide fragments and mutants thereof; classes of such receptors; polynucleotides encoding such receptors, fragments and mutants thereof, and representatives of receptor classes; genetic vectors including such polynucleotides; and cells and non-human organisms engineered to express such receptor complexes, fragments and mutants of an olfactory or taste receptor, and representatives of receptor classes to simulate sensory perception of odorants and tastants is described. The use of such products as a biosensor or a component thereof to detect, identify, measure, or otherwise process the event of binding between the receptor and its cognate ligand (i.e., chemical sensant) is also described. The invention has application, for example, in the design and formulation of odorant and tastant compositions.

14 Claims, No Drawings

RECEPTOR FINGERPRINTING, SENSORY PERCEPTION, AND BIOSENSORS OF CHEMICAL SENSANTS

CROSS REFERENCE TO RELATED APPLICATION

This application is related to U.S. Provisional Ser. No. 60/213,812, filed Jun. 22, 2000, and U.S. Ser. No. 09/804,291, filed Mar. 13, 2001, which are incorporated by reference in their entirety.

BACKGROUND OF THE INVENTION

1. Field of the Invention

The invention relates to the use of sensory G protein-coupled receptor complexes that recognize chemical sensants, particularly those involving olfactory and taste receptors; polypep-tide fragments and mutants thereof; classes of such receptors; polynucleotides encoding such receptors, fragments and mutants thereof, and representatives of receptor classes; genetic vectors including such polynucleotides; and cells and non-human organisms engineered to express such receptor complexes, fragments and mutants of an olfactory or taste receptor, and representatives of receptor classes to simulate sensory perception of odorants and tastants. The invention also relates to the use of such products as a biosensor or component thereof to detect, to identify, to measure, or otherwise process the event of binding between the receptor and its cognate ligand (i.e., chemical sensant). The invention has application, for example, in the design and formu-lation of odorant and tastant compositions.

2. Description of the Related Art

The olfactory and taste systems provide sensory information about the chemical environment. Olfactory receptors and taste receptors recognize, respectively, "odorants" and "tastants," collectively referred to as "sensants" or "sensory receptor ligands" herein. A "primary" sensant is an odorant or tastant ligand that substantially binds to sensory receptors with a ligand-binding site of a single amino acid sequence. Olfactory and taste receptors belong to the superfamily of seven-transmembrane guanyl nucleotide-binding proteins: such receptors are, however, also recognized as distinct families, or sub-genuses, of olfactory or taste receptors (see Raming *Nature* 361:353, 1993). These receptors control diverse physiological functions such as media-ting signaling from an external chemical stimulus across the membrane containing the receptor into a cell, endocrine function, exocrine function, heart rate, lipolysis, and carbohydrate metabolism. Thus, the dissection of these diverse functions into component signals is needed.

But the complexities of sensory perception of chemical sensants prevent easy translation of the olfaction and taste systems to a machine sensor. For example, U.S. Pat. Nos. 5,675,070; 5,918,257; 5,928,609; and 6,085,576 disclose machine sensors that use various chemistries, but they do not take advantage of the specificity of olfactory and taste receptors for their cognate ligands to produce a biosensor.

WO 00/15269 discloses methods and apparatus for odor reproduction. The total affinities of a specific odorant with a group of receptors was called the affinity fingerprint of the odorant. This odorant fingerprint was represented by a vector of affinity values. It was proposed to repro-duce an arbitrary odor by inputting its sensed odorant fingerprint into a device, which has a palate of predetermined odorants and produces a composite odor using predetermined odorant finger-prints by minimizing the difference between vectors representing the sensed odorant fingerprint and the predetermined odorant fingerprints. This reference, however, does not teach or suggest the human olfactory receptors disclosed herein.

WO 00/70343 discloses biosensors and sense replication systems using G-protein coupled receptors (GPCR). It was proposed to mimic the response of the G-protein signal transduction system by detecting the affinity of a stimulus to a plurality of GPCR, codifying such information into electronic signals, and reproducing the stimulus by converting the codified information into a combination of stimulant entities. But this reference also does not teach or suggest the human olfactory receptors disclosed herein.

WO 01/27158 discloses olfactory receptors and their use to determine the correspondence between individual odorant receptors and particular odors. It was proposed that the interactions between an odor and olfactory receptors can be used to represent the odor and to re-create it. This reference, however, does not teach or suggest the human olfactory receptors disclosed herein.

Dissecting the function of sensory receptors by binding sensory receptors of a clone of cells expressing a single sensory receptor gene, fragmentation of sensory receptors to provide ligand-binding or signal-transducing domains thereof, and construction of fusion sensory recep-tor proteins will separate the diverse physiological functions associated with sensory perception at the level of ligand-receptor binding. Furthermore, novel "primary sensants" that are identified and isolated by the methods described herein may be used to further define the function of the cognate sensory receptor by uniquely enhancing or, in the alternative, blocking stimulation of sensory receptors with a single ligand-binding domain.

The present invention addresses the need for better understanding of these ligand-receptor interactions by using a large set of identified sensory receptors. Even if the receptor set used is incomplete (i.e., a partial set of all sensory receptors encoded in the genome), a large number of sensants will be detected. Moreover, redundancy in the chemical structures recognized by the sensory receptors or combinatorial processing of signals from different sensory receptors would allow broad coverage of chemically diverse sensants (e.g., by selection of a representative class of sensory receptors). Also provided are, inter alia, methods for utilizing such sensory receptors and biosensors to simulate sensory perception. To analyze ligand-receptor interactions and their effects on cell signaling and the processing of those signals in sensory perception, specific sensants and their cognate receptor complexes are detected, identified, and measured under binding conditions. Fragrances and flavorings can be detected, identified, measured, and/or custom designed by the methods herein described. In addition, drugs that incorporate artificial odors and/or tastes can be formulated.

SUMMARY OF THE INVENTION

Large gene families encoding mammalian olfactory G-protein-coupled receptors (OLFR) and mammalian taste G-protein-coupled receptors (TASR) are known in the prior art or are disclosed herein. An object of the invention to provide fragments and variants of such OLFRs and TASRs which retain odorant- or tastant-binding activity, respectively. The large number of sensory receptors that are made available herein and now amendable to manipulation raises the confidence that a substantially complete, or at least functional, repertoire of sensory receptors is provided.

It is an object of the invention to provide nucleic acid sequences or molecules that encode such sensory receptors, or fragments or variants thereof. Another object is to provide expression vectors which include nucleic acid sequences that encode such sensory receptors, or fragments or variants thereof It is yet another object of the invention to provide human or non-human cells which functionally express at least one of such sensory receptors, or fragments or variants thereof. Still another object is to provide sensory receptor fusion proteins or other polypeptides which include at least a fragment of at least one of such sensory receptors. In particular, fusions with reporter molecules or other heterologous amino acid sequences may maintain the original ligand-properties while changing the signaling properties to allow easier detection of sensant binding to the receptor (e.g., change in fluorescent signal). Moreover, chimeric proteins or other polypeptides with altered ligand-binding and/or signaling properties can be made from two or more different sensory receptors by mixing domains.

The invention provides methods for representing the sensory perception of one or more chemicals (e.g., a primary sensant or mixture thereof) and/or for predicting the sensory perception of one or more chemicals in a mammal (e.g., human) using the aforementioned products. Given a known member of a ligand-receptor binding pair, one or both members of the pair (i.e., ligand, receptor, or both) may be detected, identified, and/or measured under binding conditions.

Novel molecules or combinations of molecules which elicit a desired and predetermined sensory perception in a mammal (e.g., human) can be generated by determining a value of sensory perception in a mammal for a known molecule or combination thereof; determining a value of sensory perception in a mammal for one or more unknown molecules or combinations thereof; comparing the value of sensory perception in a mammal for one or more unknown compositions to the value of sensory perception in a mammal for one or more known compositions; selecting a molecule or combination of molecules that elicits a predetermined sensory perception in a mammal; and mixing two or more unknown molecules or combinations thereof to form a molecule or combination thereof that elicits a predetermined sensory perception in a mammal. The combining step yields a single molecule or a combination thereof that elicits a predetermined sensory perception in a mammal. In particular, primary odorants that uniquely bind to olfactory receptors with a single ligand-binding domain may be such novel molecules. Variants thereof may be used (1) to enhance stimulation of a limited response by olfactory receptors with a single ligand-binding domain or (2) to block stimulation of olfactory receptors with a single ligand-binding domain to reduce or inhibit olfactory perception. An alternative method for identifying primary odorants is to identify the mutated receptors in genetic anosmias because that odorant would be expected to be recognized by only one or a few olfactory receptors affected by the mutation.

DETAILED DESCRIPTION OF THE INVENTION

Perception of Chemical Sensants

U.S. Pat. No. 5,691,188 describes how upon binding of ligand to receptor, the receptor presumably undergoes a conformational change leading to activation of the G protein. The G proteins are comprised of three subunits: a guanyl nucleotide binding $\alpha$ subunit, a $\beta$ subunit, and a $\gamma$ subunit. G proteins cycle between two forms, depending on whether GDP or GTP is bound to the $\alpha$ subunit. When GDP is bound, the G protein exists as a heterotrimer: the $G\alpha\beta\gamma$ complex. When GTP is bound, the $\alpha$ subunit dissociates from the heterotrimer, leaving a $G\beta\gamma$ complex. When a $G\alpha\beta\gamma$ complex operatively associates with an activated G protein coupled receptor in a cell membrane, the rate of exchange of GTP for bound GDP is increased and the rate of dissociation of the bound $G\alpha$ subunit from the $G\alpha\beta\gamma$ complex increases. The free $G\alpha$ subunit and $G\beta\gamma$ complex are thus capable of transmitting a signal to downstream elements of a variety of signal transduction pathways. These events from the basis for a multiplicity of different cell signaling phenomena, including for example the signaling phenomena that are identified as neurological sensory perceptions such as taste and/or smell. A high-resolution X-ray crystal structure is available for rhodopsin, a guanyl nucleotide binding protein, has been solved (Palczewski et al., *Science* 289:739, 2000). Using this structure, the portions of the amino acid sequence of sensant receptors that are responsible for ligand binding can be identified.

Sensory Perception—Olfaction

Genes encoding the olfactory receptors are active primarily in olfactory neurons (Axel *Sci. Amer.* 273:154, 1995). Individual olfactory receptor types are expressed in subsets of cells distributed in distinct zones of the olfactory epithelium (Breer *Semin. Cell Biol.* 5:25, 1994). The human genome contains thousands of genes that encode a diverse repertoire of olfactory receptors (Rouquier *Nat. Genet.* 18:243, 1998; Trask *Hum. Mol. Genet.* 7:2007, 1998). An understanding of an animal's ability to detect and discriminate among the thousands of distinct odorants or tastants, and more particularly to distinguish, for example beneficial tastants or odorants from toxic tastants or odorants, is complicated by the fact that sensory receptors belong to a multigene family with over a thousand members, and the odorant receptors number at least 500 to 1,000. Moreover, each sensory receptor neuron may express only one or a few of these receptors. With respect to odorant receptors, any given olfactory neuron can respond to a small set of odorant ligands. In addition, odorant discrimination for a given neuron may depend on the ligand specificity of the one or few receptors it expresses.

Sensory Perception—Taste

Mammals are believed to have five basic taste modalities: sweet, bitter, sour, salty, and umami (the taste of monosodium glutamate). See, e.g., Kawamura et al., *Introduction to Umami: A Basic Taste* (1987); Kinnamon et al., *Ann. Rev. Physiol.*, 54:715, 1992; Lindemann, *Physiol. Rev.*, 76:718, 1996; Stewart et al., *Am. J. Physiol.*, 272:1, 1997. Numerous physiological studies in animals have shown that taste receptor cells may selectively respond to different chemical stimuli. See, e.g., Akabas et al., *Science*, 242:1047, 1988; Gilbertson et al., *J. Gen. Physiol.*, 100:803, 1992; Bernhardt et al., *J. Physiol.*, 490:325, 1996; Cummings et al., *J. Neurophysiol.*, 75:1256, 1996.

In mammals, taste receptor cells are assembled into taste buds that are distributed into different papillae in the tongue epithelium. Circumvallate papillae, found at the very back of the tongue, contain hundreds, e.g., mice, to thousands, e.g., human, of taste buds. By contrast, foli-ate papillae, localized to the posterior lateral edge of the tongue, only contain dozens to hundreds of taste buds. Moreover, fungiform papillae contain only a single or a few taste buds, and are at the front of the tongue.

Each taste bud, depending on the species, contains 50-150 cells, including precursor cells, support cells, and taste receptor cells. See, e.g., Lindemann, *Physiol. Rev.,* 76:718, 1996. Receptor cells are innervated at their base by afferent nerve endings that transmit information to the taste centers of the cortex through synapses in the brain stem and thalamus. Elucidating the mechanisms of taste cell signaling and information processing is critical for understanding the function, regulation, and perception of the sense of taste.

Exemplary bitter substance are of 6-n-propylthiouracil (PROP), sucrose octaacetate (soa), raffinose undecaacetate (rua), cycloheximide (cyx), denatonium, copper glycinate (Gl), and quinine (qui), which bind one or more T2R taste receptors.

Structure of Receptors for Chemical Sensants

Complete or partial sequences of numerous human and other eukaryotic sensory receptors are currently known. See, e.g., Pilpel et al., *Protein Sci.,* 8:969, 1999; Mombaerts, *Annu. Rev. Neurosci.,* 22:487, 1999. See also, EP0867508A2, U.S. Pat. No. 5,874,243, WO 92/17585, WO 95/18140, WO 97/17444, WO 99/67282.

Genes encoding two hundred fifty-six (256) distinct, novel human olfactory receptors have been identified in genome sequence databases. All of the receptor genes have been initially detected by a computer DNA sequence analysis in the corresponding partially sequenced human BAC genomic clones (unfinished High Throughput Genomic Sequence database accession numbers AB045359, AP002532, AP002533, AL365440, AC073487, AL359636, AL359955, AP002535, AB045365, AL359218, AC002555, AB045361, AL359512, AC023255, AL358773, AL357767, AL358874, AC068380, AC025283, AP002407, AC018700, AC022289, AC006313, AC002556, AC011571, AL121944, AC007194, AP001112, AC021660, AP000723, AC016856, AC018700, AP000818, AC00596, AP000916, AC011517, AP001112, AP000916, AC021427, AC021427, AC020884, AC019108, AL135841, AL133410, AF186996, AL138834, AC009237, AC025249, AC010930, AC009758, AC009642, AC009758, AC025249, AF101706, AC009642, AC025249, AC021660, AC011647, AC011711, AC09642, AC020597, AC011711, AC019088, AC022882, AC011571, AL121944, AP000435, AC012616, AC010332, AC010766, AP000743, AC021809, AC011879, AC021304, AC023226, AL160314, AC021304, AC020380, AC011904, AC004977, AC021304, AP000868, AP000825, AC023080, AC022207, AC121986, AC010814, AC018700, AC021304, AC008620, AC011537, AC010760, AC027641, AC017103, AC024729, AC024257, AC025115, AP001524, AP000916, AC010814, AL162254, AC025234, AP001521, AC026090, AC019088, AC016856, AC016787, AC009594, AC026038, AQ628489, AC025942, AL163152, AC026975, AC024654, AP001803, AP001804, AL353767, AP001884, AC026083, AC018793, AP000818, AL353894, AL049734, AL355366, AC011464, AC037472, AC036111, AC019093, AC027239, AC027522, AC009545, AC021333, AC036216, AC021935, AC022762, AL356019, AC055861, AC018375, AC072059, AC068339, AC022891, AL357039, AP002345, AC044810, AC073113, AC024399, AC023564, AL390860, AC074365, AP002826, AL359636, AL391534, AC055731, AC076959, AP002826, AC019088, AC009779, AL445307, AP002512, AP000818, AC079088) by virtue of their sequence homology to some of the known human and other mammalian olfactory receptor genes. Similarly, genes encoding five and thirty-six (36) distinct, novel human T1R and T2R taste receptors, respectively, have been identified in genome sequence databases.

Alternatively, nucleic acids encoding the sensory receptors and other related polypep-tides can be isolated from a variety of sources, genetically engineered, amplified, synthesized, and/or expressed recombinantly according to the methods disclosed in WO 00/35374, which is herein incorporated by reference in its entirety.

These nucleic acids provide probes for the identification of cells expressing sensory receptors, as the nucleic acids are specifically expressed in such cells. They can also serve as tools for the generation of sensory topographical maps that elucidate the relationship between cells expressing sensory receptors and sensory neurons leading to particular regions of the brain. Furthermore, the nucleic acids and the polypeptides they encode can be used as probes to elucidate olfactant- or tastant-induced behaviors.

Nucleic acid molecules encoding a sensory receptor comprising a nucleic acid sequence that is at least 75%, 85%, 90%, 95%, or 99% identical to a nucleic acid sequence selected from those known in the prior art or disclosed herein are considered variants. Other nucleic acid molecules comprising a nucleic acid sequence that encodes a polypep-tide having an amino acid sequence at least 75%, 85%, 90%, 95%, or 99% identical to an amino acid sequence selected from those known in the prior art or disclosed herein are also considered variants. Further variants contain amino acid sequence differences in at most ten, five, four, three, two, or one amino acid residue(s).

Exemplary nucleic acid sequences may be selected from the group consisting of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 204, SEQ ID NO: 206, SEQ ID NO: 208, SEQ ID NO: 210, SEQ ID NO: 212, SEQ ID NO: 214, SEQ ID NO: 216, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO:

246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286, SEQ ID NO: 288, SEQ ID NO: 290, SEQ ID NO: 292, SEQ ID NO: 294, SEQ ID NO: 296, SEQ ID NO: 298, SEQ ID NO: 300, SEQ ID NO: 302, SEQ ID NO: 304, SEQ ID NO: 306, SEQ ID NO: 308, SEQ ID NO: 310, SEQ ID NO: 312, SEQ ID NO: 314, SEQ ID NO: 316, SEQ ID NO: 318, SEQ ID NO: 320, SEQ ID NO: 322, SEQ ID NO: 324, SEQ ID NO: 326, SEQ ID NO: 328, SEQ ID NO: 330, SEQ ID NO: 332, SEQ ID NO: 334, SEQ ID NO: 336, SEQ ID NO: 338, SEQ ID NO: 340, SEQ ID NO: 342, SEQ ID NO: 344, SEQ ID NO: 346, SEQ ID NO: 348, SEQ ID NO: 350, SEQ ID NO: 352, SEQ ID NO: 354, SEQ ID NO: 356, SEQ ID NO: 358, SEQ ID NO: 360, SEQ ID NO: 362, SEQ ID NO: 364, SEQ ID NO: 366, SEQ ID NO: 368, SEQ ID NO: 370, SEQ ID NO: 372, SEQ ID NO: 374, SEQ ID NO: 376, SEQ ID NO: 378, SEQ ID NO: 380, SEQ ID NO: 382, SEQ ID NO: 384, SEQ ID NO: 386, SEQ ID NO: 388, SEQ ID NO: 390, SEQ ID NO: 392, SEQ ID NO: 394, SEQ ID NO: 396, SEQ ID NO: 398, SEQ ID NO: 400, SEQ ID NO: 402, SEQ ID NO: 404, SEQ ID NO: 406, SEQ ID NO: 408, SEQ ID NO: 410, SEQ ID NO: 412, SEQ ID NO: 414, SEQ ID NO: 416, SEQ ID NO: 418, SEQ ID NO: 420, SEQ ID NO: 422, SEQ ID NO: 424, SEQ ID NO: 426, SEQ ID NO: 428, SEQ ID NO: 430, SEQ ID NO: 432, SEQ ID NO: 434, SEQ ID NO: 436, SEQ ID NO: 438, SEQ ID NO: 440, SEQ ID NO: 442, SEQ ID NO: 444, SEQ ID NO: 446, SEQ ID NO: 448, SEQ ID NO: 450, SEQ ID NO: 452, SEQ ID NO: 454, SEQ ID NO: 456, SEQ ID NO: 458, SEQ ID NO: 460, SEQ ID NO: 462, SEQ ID NO: 464, SEQ ID NO: 466, SEQ ID NO: 468, SEQ ID NO: 470, SEQ ID NO: 472, SEQ ID NO: 474, SEQ ID NO: 476, SEQ ID NO: 478, SEQ ID NO: 480, SEQ ID NO: 482, SEQ ID NO: 484, SEQ ID NO: 486, SEQ ID NO: 488, SEQ ID NO: 490, SEQ ID NO: 492, SEQ ID NO: 494, SEQ ID NO: 496, SEQ ID NO: 498, SEQ ID NO: 500, SEQ ID NO: 502, SEQ ID NO: 504, SEQ ID NO: 506, SEQ ID NO: 508, SEQ ID NO: 510; and SEQ ID NO: 512.

Nucleic acid molecule comprising a nucleic acid sequence that encodes a fragment of a polypeptide having an amino acid sequence selected from those known in the prior art or dis-closed herein; wherein the fragment is at least ten, 20, 30, 50, 70, 100, or 150 amino acid resi-dues in length, are useful as probes, primers, and to construct hybrids or chimerae.

Polypeptides comprising an amino acid sequence that is at least 90%, 95%, 96%, 97%, 98%, or 99% identical to an amino acid sequence selected from those known in the prior art or disclosed herein are considered variants. Further variants contain amino acid sequence differences in at most ten, five, four, three, two, or one amino acid residue(s). Other polypeptides comprising a fragment of a polypeptide having an amino acid sequence selected from those known in the prior art or disclosed herein; wherein the fragment is at least 40, 60, 80, 100, 150, 200, or 250 amino acid residues in length, are useful as specific binders of sensants, competitive binders, antigens, and to construct hybrids or chimerae.

Exemplary amino acid sequences may be selected from the group consisting of SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 203, SEQ ID NO: 205, SEQ ID NO: 207, SEQ ID NO: 209, SEQ ID NO: 211, SEQ ID NO: 213, SEQ ID NO: 215, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255, SEQ ID NO: 257, SEQ ID NO: 259, SEQ ID NO: 261, SEQ ID NO:, 263, SEQ ID NO:, 265, SEQ ID NO: 267, SEQ ID NO: 269, SEQ ID NO: 271, SEQ ID NO: 273, SEQ ID NO: 275, SEQ ID NO: 277, SEQ ID NO: 279, SEQ ID NO: 281, SEQ ID NO: 283, SEQ ID NO: 285, SEQ ID NO: 287, SEQ ID NO: 289, SEQ ID NO: 291, SEQ ID NO: 293, SEQ ID NO: 295, SEQ ID NO: 297, SEQ ID NO: 299, SEQ ID NO: 301, SEQ ID NO: 303, SEQ ID NO: 305, SEQ ID NO: 307, SEQ ID NO: 309, SEQ ID NO: 311, SEQ ID NO: 313, SEQ ID NO: 315, SEQ ID NO: 317, SEQ ID NO: 319, SEQ ID NO: 321, SEQ ID NO: 323, SEQ ID NO: 325, SEQ ID NO: 327, SEQ ID NO: 329, SEQ ID NO: 331, SEQ ID NO: 333, SEQ ID NO: 335, SEQ ID NO: 337, SEQ ID NO: 339, SEQ I) NO: 341, SEQ ID NO: 343, SEQ ID NO: 345, SEQ ID NO: 347, SEQ ID NO: 349, SEQ ID NO: 351, SEQ ID NO: 353, SEQ ID NO: 355, SEQ ID NO: 357, SEQ ID NO: 359, SEQ ID NO: 361, SEQ ID NO: 363, SEQ ID NO: 365, SEQ ID NO: 367, SEQ ID NO: 369, SEQ ID NO: 371, SEQ ID NO: 373, SEQ ID NO: 375, SEQ ID NO: 377, SEQ ID NO: 379, SEQ ID NO: 381, SEQ ID NO: 383, SEQ ID NO: 385, SEQ ID NO: 387, SEQ ID NO: 389, SEQ ID NO: 391, SEQ ID NO: 393, SEQ ID NO: 395, SEQ ID NO: 397, SEQ ID NO: 399, SEQ ID NO: 401, SEQ ID NO: 403, SEQ ID NO: 405, SEQ ID NO: 407, SEQ ID NO: 409, SEQ ID NO: 411, SEQ ID NO: 413, SEQ ID NO: 415, SEQ ID NO: 417, SEQ ID NO: 419, SEQ ID NO: 421, SEQ ID NO: 423, SEQ ID NO: 425, SEQ ID NO: 427, SEQ ID NO: 429, SEQ ID NO: 431, SEQ ID NO: 433, SEQ ID NO: 435, SEQ ID NO: 437, SEQ ID NO: 439, SEQ ID NO: 441, SEQ ID NO: 443, SEQ ID NO: 445, SEQ ID NO: 447, SEQ ID NO: 449, SEQ ID NO: 451, SEQ ID NO: 453, SEQ ID NO: 455, SEQ ID NO: 457, SEQ ID NO: 459, SEQ ID NO: 461, SEQ ED NO: 463, SEQ ID NO: 465, SEQ ID NO: 467, SEQ ID NO: 469, SEQ ID NO: 471, SEQ ED NO: 473, SEQ ID NO: 475, SEQ ID NO: 477, SEQ ID NO: 479, SEQ ID NO: 481, SEQ ID NO: 483, SEQ ID NO: 485, SEQ ID NO: 487, SEQ ID NO: 489, SEQ ID NO: 491, SEQ ID NO: 493, SEQ ID NO: 495, SEQ ID NO: 497, SEQ ID NO: 499, SEQ ID NO: 501, SEQ ID NO: 503, SEQ ID NO: 505, SEQ ID NO: 507, SEQ ID NO: 509 and SEQ ID NO: 511.

Also provided are methods of screening for modulators, e.g., activators, inhibitors, stimu-lators, enhancers, agonists, and antagonists, of the sensory receptors, or fragments or variants thereof. Such modulators of signal transduction are useful for pharmacological or genetic modu-lation of signaling pathways. These methods of screening can be used to identify high affinity agonists and antagonists of sensory cell activity. These modulator compounds can then be used in the pharmaceutical, food, and cosmetic industries to customize odorants or tastants.

Thus, the invention provides assays for sensory modulation, where the sensory receptors, or fragments or variants thereof, act as direct or indirect reporter molecules for the effect of modulators on signal transduction. Sensory receptors, or fragments or variants thereof, can be used in assays, e.g., to measure changes in ion concentration, membrane potential, current flow, ion flux, transcription, signal transduction, receptor-ligand interaction, second messenger concentrations, in vitro, in vivo, and ex vivo. In one embodiment, sensory receptors, or fragments or variants thereof, can be used as an indirect reporters via attachment to second reporter molecules, such as green fluorescent protein (see, e.g., Mistili et al, *Nature Biotech.*, 15:961, 1997). In another embodiment, the sensory receptors, or fragments or variants thereof, can be expressed in host cells, and modulation of signal transduction via sensory receptor activity can be assayed by measuring changes in $Ca^{2+}$ levels.

Methods of assaying for modulators of signal transduction include in vitro ligand binding assays using the sensory receptors, or fragments or variants thereof. More particularly, such assays can use the sensory receptors; portions thereof such as the extracellular or transmembrane domains; chimeric proteins comprising one or more of such domains; oocyte receptor expression; tissue culture cell receptor expression; transcriptional activation of the receptor; G-protein binding to the receptor; ligand binding assays; voltage, membrane potential and conductance changes; ion flux assays; changes in intracellular second messengers such as cAMP and inositol triphosphate; changes in intracellular $Ca^{2+}$ levels; and neurotransmitter release.

The invention also provides for methods of detecting sensory receptor nucleic acid and protein expression, allowing for the investigation of taste transduction regulation and specific identification of sensory receptor cells. The sensory receptors, fragments, and variants of the invention can also be used to generate monoclonal and polyclonal antibodies useful for identifying a sensory receptor cells. Sensory receptor cells can be identified using techniques such as reverse transcription and amplification of mRNA, isolation of total RNA or poly $A^+$ RNA, Northern blotting, dot blotting, in situ hybridization, RNase protection, S1 digestion, probing DNA microchip arrays, Western blots, and the like.

A. Identification and Characterization of Sensory Receptors

The amino acid sequences of the sensory receptors and polypeptides of the invention can be identified by putative translation of the coding nucleic acid sequences. These various amino acid sequences and the coding nucleic acid sequences may be compared to one another or to other sequences according to a number of methods.

For example, in sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, as described below for the BLASTN and BLASTP programs, or alternative parameters can be designated. The sequence comparison algorithm then calculates the percent sequence identities for the test sequences relative to the reference sequence, based on the program parameters.

A "comparison window," as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482, 1981, by the homology alignment algorithm of Needleman & Wunsch, *J. Mol. Biol.* 48:443, 1970, by the search for similarity method of Pearson & Lipman, *Proc. Natl. Acad Sci. USA* 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

A preferred example of an algorithm that is suitable for determining percent sequence identity and sequence similarity are the BLAST and BLAST 2.0 algorithms, which are described in Altschul et al., *Nucl. Acids Res.* 25:3389, 1977 and Altschul et al., *J. Mol. Biol.* 215:403, 1990, respectively. Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., Altschul et al., *Nucl. Acids Res.* 25:3389, 1977 and Altschul et al., *J. Mol. Biol.* 215:403, 1990). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, *Proc. Natl. Acad Sci. USA* 89:10915, 1989) alignments (B) of 50, expectation (E) of 10, M=5, N=−4, and a comparison of both strands.

Another example of a useful algorithm is PILEUP. PILEUP creates a multiple sequence alignment from a group of related sequences using progressive, pairwise alignments to show relationship and percent sequence identity. It also plots a so-called "tree" or "dendogram" showing the clustering relationships used to create the alignment (see, e.g., FIG. 2). PILEUP uses a simplification of the progressive alignment method of Feng & Doolittle, *J Mol. Evol.* 35:351, 1987. The method used is similar to the method described by Higgins & Sharp, CABIOS 5:151, 1989. The program can align up to 300 sequences, each of a maximum length of 5,000 nucleotides or amino acids. The multiple alignment procedure begins with the pairwise alignment of the two most similar sequences, producing a cluster of two aligned sequences. This cluster is then aligned to the next most related sequence or cluster of aligned sequences. Two clusters of sequences are aligned by a simple extension of the pairwise alignment of two individual sequences. The final alignment is achieved by a series of progressive, pairwise alignments. The program is run by designating specific sequences and their amino acid or nucleotide coordinates for regions of sequence comparison and by designating the program parameters. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g., version 7.0 (Devereaux et al., *Nucl. Acids Res.* 12:387, 1984) encoded by the genes were derived by conceptual translation of the corresponding open reading frames. Comparison of these protein sequences to all known proteins in the public sequence databases using BLASTP algorithm revealed their strong homology to the members of the mammalian olfactory receptor family, each of the olfactory receptor sequences having at least 50%, and preferably at least 55%, at least 60%, at least 65%, and most preferably at least 70%, amino acid identity to at least one known member of the family.

The nucleic acid molecules of the present invention are typically intronless and encode putative sensory receptor proteins generally having lengths of about 300 to about 400 amino acid residues that contain seven transmembrane domains, as predicted by hydrophobicity plotting analysis, indicating that they belong to the G protein-coupled receptor superfamily, which includes the subset of taste and olfactory receptors. In addition to the overall structural similarity, each of the 256 sensory receptors identified herein has a characteristic sequence signature of an olfactory receptor. In particular, all 256 sequences contain very close matches to the following consensus amino acid motifs (Mombaerts, 1999; Pilpel, 1999): LHTPMY in intracellular loop 1, MAYDRYVAIC at the end of transmembrane domain 3 and the beginning of intracellular loop 2, SY at the end of transmembrane domain 5, FSTCSSH in the beginning of transmembrane domain 6, and PMLNPF in transmembrane domain 7. Combination of all the above mentioned structural features of the 256 genes and encoded proteins strongly suggests that they represent novel members of the human olfactory receptor family.

As noted above, complete or partial sequences of numerous human and other eukaryotic sensory receptors are currently known. The novel human receptors have amino acid sequences distinctly different from the previously known human sensory receptors, which suggests their different specificity in sensant recognition. Therefore, these novel sensory receptors and their genes can be used, alone or in combination with known sensory receptors, in developing detec-tion systems and assays for chemically distinct types of sensants not recognized by the known sensory receptors, as well as for diagnostic and research purposes.

B. Definitions

The terms "purified," "substantially purified," and "isolated" as used herein refer to the state of being free of other, dissimilar compounds with which the compound of the invention is normally associated in its natural state, so that the "purified," "substantially purified," and "isolated" subject comprises at least 0.5%, 1%, 5%, 10%, or 20%, and most preferably at least 50% or 75% of the mass, by weight, of a given sample. In one preferred embodiment, these terms refer to the compound of the invention comprising at least 95% of the mass, by weight, of a given sample. As used herein, the terms "purified," "substantially purified," and "isolated" "isolated," when referring to a nucleic acid or protein, of nucleic acids or proteins, also refers to a state of purification or concentration different than that which occurs naturally in the mammalian, especially human, body. Any degree of purification or concentration greater than that which occurs naturally in the mammalian, especially human, body, including (1) the purification from other associated structures or compounds or (2) the association with structures or compounds to which it is not normally associated in the mammalian, especially human, body, are within the meaning of "isolated." The nucleic acid or protein or classes of nucleic acids or proteins, described herein, may be isolated, or otherwise associated with structures or compounds to which they are not normally associated in nature, according to a variety of methods and processes known to those of skill in the art.

The terms "amplifying" and "amplification" refer to the use of any suitable amplification methodology for generating or detecting recombinant or naturally expressed nucleic acid, as described in detail, below. For example, the invention provides methods and reagents (e.g., specific degenerate oligonucleotide primer pairs) for amplifying (e.g., by polymerase chain reaction, PCR) naturally expressed (e.g., genomic or mRNA) or recombinant (e.g., cDNA) nucleic acids of the invention (e.g., sensant-binding sequences of the invention) in vivo or in vitro.

The term "7-transmembrane receptor" means a polypeptide belonging to a superfamily of transmembrane proteins that have seven domains that span the plasma membrane seven times (thus, the seven domains are called "transmembrane" or "TM" domains TM I to TM VII). The families of olfactory and taste receptors each belong to this superfamily. Seven-transmembrane receptor polypeptides have similar and characteristic primary, secondary and tertiary structures, as discussed in further detail below.

The term "expression vector" refers to any recombinant expression system for the purpose of expressing a nucleic acid sequence of the invention in vitro or in vivo, constitutively or inducibly, in any cell, including prokaryotic, yeast, fungal, plant, insect or mammalian cell. The term includes linear or circular expression systems. The term includes expression systems that remain episomal or integrate into the host cell genome. The expression systems can have the ability to self-replicate or not, i.e., drive only transient expression in a cell. The term includes recombinant expression "cassettes which contain only the minimum elements needed for transcription of the recombinant nucleic acid.

The term "library" means a preparation that is a mixture of different nucleic acid or polypeptide molecules, such as the library of recombinantly generated sensory, particularly olfactory or taste, receptor ligand-binding domains generated by amplification of nucleic acid with degenerate primer pairs, or an isolated collection of vectors that incorporate the amplified sensant-binding domains, or a mixture of cells each randomly transfected with at least one vector encoding a sensory receptor.

The term "nucleic acid" or "nucleic acid sequence" refers to a deoxy-ribonucleotide or ribonucleotide oligonucleotide in either single- or double-stranded form. The term encompasses nucleic acids, i.e., oligonucleotides, containing known analogs of natural nucleotides. The term also encompasses nucleic-acid-like structures with synthetic backbones, see e.g., *Oligonucleo-tides and Analogues, a Practical Approach*, ed. F. Eckstein, Oxford Univ. Press (1991); *Anti-sense Strategies*, Annals of the N.Y. Academy of Sciences, Vol. 600, Eds. Baserga et al. (NYAS 1992); Milligan (1993) *J. Med. Chem.* 36:1923-1937; *Antisense Research and Applications* (1993, CRC Press), WO 97/03211; WO 96/39154; Mata (1997) *Toxicol. Appl. Pharmacol.* 144:189-197; Strauss-Soukup (1997) *Biochemistry* 36:8692-8698; Samstag (1996) *Antisense Nucleic Acid Drug Dev* 6:153-156.

The term sensory receptor "ligand-binding region" refers to sequences derived from a sensory receptor that substantially incorporates transmembrane domains II to VII (TM II to VII). The domain may be capable of binding a sensant.

The terms "conservative variant" or "analog" or "mimetic" refer to a polypeptide which has a modified amino acid sequence, such that the change(s) do not substantially alter the poly-peptide's (the conservative variant's) structure and/or activity, as defined herein. These include conservatively modified variations of an amino acid sequence, i.e., amino acid substitutions, additions or deletions of those residues that are not critical for protein activity, or substitution of amino acids with residues having similar properties (e.g., acidic, basic, positively or negatively charged, polar or non-polar, etc.) such that the substitutions of even critical amino acids does not substantially alter structure and/or activity. Conservative substitution tables providing function-ally similar amino acids are well known in the art.

For example, one exemplary guideline to select conservative substitutions includes (original residue followed by exemplary substitution): Ala/Gly or Ser; Arg/Lys; Asn/Gln or His; Asp/Glu; Cys/Ser; Gln/Asn; Gly/Asp; Gly/Ala or Pro; His/Asn or Gln; Ile/Leu or Val; Leu/Ile or val; Lys/Arg or Gln or Glu; Met/Leu or Tyr or Ile; Phe/Met or Leu or Tyr; Ser/Thr; Thr/Ser; Trp/Tyr; Tyr/Trp or Phe; Val/Ile or Leu. An alternative exemplary guideline uses the following six groups, each containing amino acids that are conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (I); 5) Isoleucine (I), Leucine (L), Methionine (M), Valine (V); and 6) Phenylalanine (F), Tyrosine (Y), Tryptophan (W); (see also, e.g., Creighton, *Proteins*, W. H. Freeman, 1984; Schultz & Schimer, *Principles of Protein Structure*, Springer-Verlag, 1979). One of skill in the art will appreciate that the above-identified substitutions are not the only possible conservative substitutions. For example, for some purposes, one may regard all charged amino acids as conservative substitutions for each other whether they are positive or negative. In addition, individual substitutions, deletions or additions that alter, add or delete a single amino acid or a small percentage of amino acids in an encoded sequence can also be considered "conservatively modified variations."

The terms "mimetic" and "peptidomimetic" refer to a synthetic chemical compound that has substantially the same structural and/or functional characteristics of the polypeptides, e.g., translocation domains or sensant-binding domains or chimeric receptors of the invention. The mimetic can be either entirely composed of synthetic, non-natural analogs of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experi-mentation will determine whether a mimetic is within the scope of the invention, i.e., that its structure and/or function is not substantially altered. Polypeptide mimetic compositions can contain any combination of non-natural structural components, which are typically from three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. A polypeptide can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcrabodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$), thiazole, retroamide, thioamide, or ester (see, e.g., Spatola (1983) in *Chemistry and Biochemistry of Amino Acids, Peptides and Proteins*, Vol. 7, pp 267-357, "Peptide Backbone Modifications," Marcell Dekker, NY). A polypeptide can also be characterized as a mimetic by containing all or some non-natural residues in place of naturally occurring amino acid residues; non-natural residues are well described in the scientific and patent literature.

As used herein, "recombinant" refers to a polynucleotide synthesized or otherwise manipulated in vitro (e.g., "recombinant polynucleotide"), to methods of using recombinant polynucleotides to produce gene products in cells or other biological systems, or to a polypeptide ("recombinant protein") encoded by a recombinant polynucleotide. "Recombinant means" also encompass the ligation of nucleic acids having various coding regions or domains or promoter sequences from different sources into an expression cassette or vector for expression of, e.g., inducible or constitutive expression of a fusion protein comprising a translocation domain of the invention and a nucleic acid sequence amplified using a primer of the invention.

The term "transmembrane domain" means a polypeptide domain that can completely span the plasma membrane. The general secondary and tertiary structure of transmembrane domains, in particular the seven transmembrane domains of 7-transmembrane receptors such as olfactory receptors, are well known in the art. Thus, primary structure sequence can be designed or predicted based on known transmembrane domain sequences, as described in detail below.

C. Isolation and Expression of Olfactory Receptors

Isolation and expression of the sensory receptors, or fragments or variants thereof, of the invention can be performed as described below. PCR primers can be used for the amplification of nucleic acids encoding olfactory receptor ligand binding regions and libraries of these nucleic acids can thereby be generated. Libraries of expression vectors can then be used to infect or transfect host cells for the functional expression of these libraries. These genes and vectors can be made and expressed in vitro or in vivo. One of skill will recognize that desired phenotypes for altering and controlling nucleic acid expression can be obtained by modulating the expression or activity of the genes and nucleic acids (e.g., promoters, enhancers and the like) within the vectors of the invention. Any of the known methods described for increasing or decreasing expression or activity can be used. The invention can be practiced in conjunction with any method or protocol known in the art, which are well described in the scientific and patent literature.

The nucleic acid sequences of the invention and other nucleic acids used to practice this invention, whether RNA, cDNA, genomic DNA, vectors, viruses or hybrids thereof, may be isolated from a variety of sources, genetically engineered, amplified, and/or expressed recombinantly. Any recombinant expression system can be used, including, in addition to mammalian cells, e.g., bacterial, yeast, insect or plant systems.

Alternatively, these nucleic acids can be synthesized in vitro by well-known chemical synthesis techniques, as described in, e.g., Carruthers, *Cold Spring Harbor Symp. Quant. Biol.* 47:411-418 (1982); Adams, *Am. Chem. Soc.* 105:661 (1983); Belousov, *Nucleic Acids Res.* 25:3440-3444 (1997); Frenkel, *Free Radic. Biol. Med.* 19:373-380 (1995); Blommers, *Biochemistry* 33:7886-7896 (1994); Narang, *Meth. Enzymol.* 68:90 (1979); Brown, *Meth. Enzymol.* 68:109 (1979); Beaucage, *Tetra. Lett.* 22:1859 (1981); U.S. Pat. No. 4,458,066. Double-stranded DNA fragments may then be obtained either by synthesizing the complementary strand and annealing the strands together under appropriate conditions, or by adding the complementary strand using DNA polymerase with an appropriate primer sequence.

Techniques for the manipulation of nucleic acids, such as, for example, for generating mutations in sequences, subcloning, labeling probes, sequencing, hybridization and the like are well described in the scientific and patent literature. See, e.g., Sambrook, ed., *Molecular Cloning: a Laboratory manual* (2nd ed.), Vols. 1-3, Cold Spring Harbor Laboratory (1989); *Current Protocols in Molecular Biology*, Ausubel, ed. John Wiley & Sons, Inc., New York (1997); *Laboratory Techniques in Biochemistry and Molecular Biology: Hybridization With Nucleic Acid Probes, Part I, Theory and Nucleic Acid Preparation*, Tijssen, ed. Elsevier, N.Y. (1993).

Nucleic acids, vectors, capsids, polypeptides, and the like can be analyzed and quantified by any of a number of general means well known to those of skill in the art. These include, e.g., analytical biochemical methods such as NMR, spectrophotometry, radiography, electrophoresis, capillary electrophoresis, high performance liquid chromatography (HPLC), thin layer chromato-graphy (TLC), and hyperdiffusion chromatography, various immunological methods, e.g., fluid or gel precipitin reactions, immunodiffusion, immunoelectrophoresis, radioimmunoassay (RIA), enzyme-linked immunosorbent assay (ELISA), immunofluorescent assay, Southern analysis, Northern analysis, dot-blot analysis, gel electrophoresis (e.g., SDS-PAGE), RT-PCR, quan-tita-tive PCR, other nucleic acid or target or signal amplification methods, radiolabeling, scintillation counting, and affinity chromatography.

Oligonucleotide primers are used to amplify nucleic acid encoding an olfactory receptor ligand-binding region. The nucleic acids described herein can also be cloned or measured quan-titatively using amplification techniques. Using exemplary degenerate primer pair sequences, (see below), the skilled artisan can select and design suitable oligonucleotide amplification primers. Amplification methods are also well known in the art, and include, e.g., polymerase chain reaction, PCR (*PCR Protocols, a Guide to Methods and Applications*, ed. Innis. Academic Press, NY, 1990 and *PCR Strategies*, ed. Innis, Academic Press, NY, 1995), ligase chain reaction (LCR) (see, e.g., Wu, *Genomics* 4:560, 1989; Landegren, *Science* 241:1077, 1988; Barringer, *Gene* 89:117, 1990); transcription amplification (see, e.g., Kwoh, *Proc. Natl. Acad. Sci. USA* 86:1173, 1989); and, self-sustained sequence replication (see, e.g., Guatelli, *Proc. Natl. Acad. Sci. USA* 87:1874, 1990); Q Beta replicase amplification (see, e.g., Smith, *J. Clin. Microbiol.* 35:1477, 1997); automated Q-beta replicase amplification assay (see, e.g., Burg, *Mol. Cell. Probes* 10:257, 1996) and other RNA polymerase mediated techniques (e.g., NASBA, Cangene, Mississauga, Ontario); see also Berger, *Methods Enzymol.* 152:307, 1987; Sambrook; Ausubel; U.S. Pat. Nos. 4,683,195 and 4,683,202; Sooknanan, *Biotechnology* 13:563, 1995.

Once amplified, the nucleic acids, either individually or as libraries, may be cloned according to methods known in the art, if desired, into any of a variety of vectors using routine molecular biological methods; methods for cloning in vitro amplified nucleic acids are described, e.g., U.S. Pat. No. 5,426,039. To facilitate cloning of amplified sequences, restriction enzyme sites can be "built into" the PCR primer pair. For example, Pst I and Bsp E1 sites were designed into the exemplary primer pairs of the invention. These particular restriction sites have a sequence that, when ligated, are "in-frame" with respect to the 7-membrane receptor "donor" coding sequence into which they are spliced (the sensant-binding region-coding sequence is internal to the 7-membrane polypeptide, thus, if it is desired that the construct be translated downstream of a restriction enzyme splice site, out of frame results should be avoided; this may not be necessary if the inserted sensant-binding domain comprises substantially most of the transmembrane VII region). The primers can be designed to retain the original sequence of the "donor" 7-membrane receptor (the Pst I and Bsp E1 sequence in he primers of the invention generate an insert that, when ligated into the Pst I/Bsp E1 cut vector, encode residues found in the "donor" mouse olfactory receptor M4 sequence). Alternatively, the primers can encode amino acid residues that are conservative substitutions (e.g., hydrophobic for hydrophobic residue, see above discussion) or functionally benign substitutions (e.g., do not prevent plasma membrane insertion, cause cleavage by peptidase, cause abnormal folding of receptor, and the like).

The primer pairs are designed to selectively amplify sensant-binding regions of olfactory receptor proteins. These domain regions may vary for different sensnants, and more particularly odorants; thus, what may be a minimal binding region for one sensant, and more particularly odorants, may be too limiting for a second potential ligand. Thus, domain regions of different sizes comprising different domain structures may be amplified; for example, transmembrane (TM) domains II through VII, III through VII, III through VI or II through VI, or variations thereof (e.g., only a subsequence of a particular domain, mixing the order of the domains, and the like), of a 7-transmembrane sensory receptor.

As domain structures and sequence of many 7-membrane proteins, particularly olfactory receptors, are known, the skilled artisan can readily select domain-flanking and internal domain sequences as model sequences to design degenerate amplification primer pairs. For example, a nucleic acid sequence encoding domain regions II through VII can be generated by PCR amplification using a primer pair. To amplify a nucleic acid comprising transmembrane domain I (TM I) sequence, a degenerate primer can be designed from a nucleic acid that encodes the amino acid sequence LFLLYL. Such a degenerate primer can be used to generate a binding domain incorpo-rating TM I through TM III, TM I through TM IV, TM I through TM V, TM I through TM VI or TM I through TM VII.

To amplify a nucleic acid comprising a transmembrane domain III (TM III) sequence, a degenerate primer (of at least about 17 residues) can be designed from a nucleic acid that encodes the amino acid sequence M(A/G)(Y/F)DRYVAI (encoded by a nucleic acid sequence such as 5'-ATGG(G/C)CT(A/T)TGACCG(C/A/T)T(AT)(C/T)GT-3'). Such a Means to synthesize oligonucleotide primer pairs are well known in the art. "Natural" base pairs or synthetic base pairs can be used. For example, use of artificial nucleobases offers a versatile approach to manipulate primer sequence and generate a more complex mixture of amplification products. Various families of artificial nucleobases are capable of assuming multiple hydrogen bonding orientations through internal bond rotations to provide a means for degenerate molecular recognition. Incorporation of these analogs into a single position of a PCR primer allows for generation of a complex library of amplification products. See, e.g., Hoops, *Nucleic Acids Res.* 25:4866, 1997. Nonpolar molecules can also be used to mimic the shape of natural DNA bases. A non-hydrogen-bonding shape mimic for adenine can replicate efficiently and selectively against a nonpolar shape mimic for thymine (see, e.g., Morales, *Nat. Struct. Biol.* 5:950, 1998). For example, two degenerate bases can be the pyrimidine base 6H, 8H-3,4-dihydropyrimido[4,5-c][1,2]oxazin-7-one or the purine base N6-methoxy-2,6-diaminopurine (see, e.g., Hill, *Proc. Natl. Acad. Sci. USA* 95:4258, 1998). Exemplary degenerate primers of the invention incorporate the nucleobase analog 5'-Dimethoxytrityl-N-benzoyl-2'-deoxy-Cytidine, 3'-[(2-cyanoethyl)-(N,N-diisopropyl)]-phosphoramidite (the term "P" in the sequences, see above). This pyrimidine analog hydrogen bonds with purines, including A and G residues.

Exemplary primer pairs for amplification of olfactory receptor transmembrane domains II through VII include:

```
(a)  5'-GGGGTCCGGAG(A/G)(C/G)(A/G)TA(A/G/T)AT(A/G/P)A(A/G/P)(A/G/P)GG-
     3' and
     5'-
     GGGGCTGCAGACACC(A/C/G/T)ATGTA(C/T)(C/T)T(A/C/G/T)TT(C/T)(C/T)T-
     3'-
(b)  5'-GGGGTCCGGAG(A/G)(C/G)T(A/G)A(A/G/T)AT(A/G/P)A(A/G/P)(A/G/P)GG-
     3' and
     5'-
     GGGGCTGCAGACACC(AC/G/T)ATGTA(C/T)(C/T)T(A/C/G/T)TT(C/T)(C/T)T-
     3'.
(c)  5'-
     GGGGTCCGGAG(A/G)(C/G)T(A/G)A(A/G/T)AT(A/G/C/T)A(A/G/C/T)(A/G/C/T)
     GG-3' and
     5'-GGGGCTGCAGACACC(A/C/G/T)ATGTA(C/T)(C/T)T(A/C/G/T)
     TT(C/T)(C/T)T-3'.
``` degenerate primer can be used to generate a binding domain incorporating TM III through TM IV, TM III through TM V, TM III through TM VI or TM III through TM VII.

To amplify a transmembrane domain VI (TM VI) sequence, a degenerate primer (of at least about 17 residues) can be designed from nucleic acid encoding an amino acid sequence TC(G/A)SHL, encoded by a sequence such as 5'-AG(G/A)TGN(G/C)(T/A)N(G/C)C(G/A)CA-NGT-3'. Such a degenerate primer can be used to generate a binding domain incorporating TM I through TM VI, TM II through TM VI, TM III through TM VI or TM IV through TM VI).

Paradigms to design degenerate primer pairs are well known in the art. For example, a COnsensus-DEgenerate Hybrid Oligonucleotide Primer (CODEHOP) strategy computer program is accessible as http://blocks.fhcrc.org/codehop.html, and is directly linked from the BlockMaker multiple sequence alignment site for hybrid primer prediction beginning with a set of related protein sequences, as known olfactory receptor ligand-binding regions (see, e.g., Rose, *Nucl. Acids Res.* 26:1628, 1998; Singh, *Biotechniques* 24:318, 1998).

Nucleic acids that encode ligand-binding regions of olfactory receptors are generated by amplification (e.g., PCR) of appropriate nucleic acid sequences using degenerate primer pairs. The amplified nucleic acid can be genomic DNA from any cell or tissue or mRNA or cDNA derived from olfactory receptor-expressing cells, e.g. olfactory neurons or olfactory epithelium.

Isolation from olfactory receptor-expressing cells is well known in the art (cells expressing naturally or inducibly expressing olfactory receptors can be used to express the hybrid olfactory receptors of the invention to screen for potential odorants and odorant effect on cell physiology, as described below). For example, cells can be identified by olfactory marker protein (OMP), an abundant cytoplasmic protein expressed almost exclusively in mature olfactory sensory neurons (see, e.g., Buiakova, *Proc. Natl. Acad. Sci. USA* 93:9858, 1996). Shirley, *Eur. J. Biochem.* 32:485, 1983), describes a rat olfactory preparation suitable for biochemical studies in vitro on olfactory mechanisms. Cultures of adult rat olfactory receptor neurons are described by Vargas, *Chem. Senses* 24:211, 1999). Because these cultured neurons exhibit typical voltage-gated currents and are responsive to application of odorants, they can also be used to express the hybrid olfactory receptors of the invention for odorant screening (endogenous olfactory receptor can be initially blocked, if desired, by, e.g., antisense, knockout, and the like). U.S. Pat. No. 5,869,266 describes culturing human olfactory neurons for neurotoxicity tests and screening. Murrell, *J. Neurosci.* 19:8260, 1999), describes differentiated olfactory receptor-expressing cells in culture that respond to odorants, as measured by an influx of calcium.

Hybrid protein-coding sequences comprising nucleic acids sensory receptors fused to the translocation sequences described herein may be constructed. Also provided are hybrid receptors comprising the translocation motifs and ligand-binding domains of sensory receptors. These nucleic acid sequences can be operably linked to transcriptional or translational control elements, e.g., transcription and translation initiation sequences, promoters and enhancers, transcription and translation terminators, polyadenylation sequences, and other sequences useful for transcribing DNA into RNA. In construction of recombinant expression cassettes, vectors, transgenics, and a promoter fragment can be employed to direct expression of the desired nucleic acid in all tissues. Olfactory cell-specific transcriptional elements can also be used to express the fusion polypeptide receptor, including, e.g., a 6.7 kb region upstream of the M4 olfactory receptor coding region. This region was sufficient to direct expression in olfactory epithelium with wild type zonal restriction and distributed neuronal expression for endogenous olfactory receptors (Qasba, *J. Neurosci.* 18:227, 1998). Receptor genes are normally expressed in a small subset of neurons throughout a zonally restricted region of the sensory epithelium. The transcriptional or translational control elements can be isolated from natural sources, obtained from such sources as ATCC or GenBank libraries, or prepared by synthetic or recombinant methods.

Fusion proteins, either having C-terminal or, more preferably, N-terminal translocation sequences, may also comprise the translocation motif described herein. However, these fusion proteins can also comprise additional elements for, e.g., protein detection, purification, or other applications. Detection and purification facilitating domains include, e.g., metal chelating peptides such as polyhistidine tracts or histidine-tryptophan modules or other domains that allow purification on immobilized metals; maltose binding protein; protein A domains that allow purification on immobilized immunoglobulin; or the domain utilized in the FLAGS extension/affinity purification system (Immunex Corp, Seattle Wash.).

The inclusion of a cleavable linker sequences such as Factor Xa (see, e.g., Ottavi, *Biochi-mie* 80:289, 1998), subtilisin protease recognition motif (see, e.g., Polyak, *Protein Eng.* 10:615, 1997); enterokinase (Invitrogen, San Diego, Calif.), and the like, between the translocation domain (for efficient plasma membrane expression) and the rest of the newly translated polypeptide may be useful to facilitate purification. For example, one construct can include a nucleic acid sequence encoding a polypeptide linked to six histidine residues followed by a thioredoxin, an enterokinase cleavage site (see, e.g., Williams, *Biochemistry* 34:1787, 1995), and an amino terminal translocation domain. The histidine residues facilitate detection and purification while the enterokinase cleavage site provides a means for purifying the desired protein(s) from the remainder of the fusion protein. Technology pertaining to vectors encoding fusion proteins and application of fusion proteins are well described in the scientific and patent literature, see, e.g., Kroll, *DNA Cell. Biol.* 12:441, 1993).

Expression vectors, either as individual expression vectors or as libraries of expression vectors, comprising the olfactory binding domain-encoding sequences may be introduced into a genome or into the cytoplasm or a nucleus of a cell and expressed by a variety of conventional techniques, well described in the scientific and patent literature. See, e.g., Roberts, *Nature* 328:731, 1987; Berger supra; Schneider, *Protein Expr. Purif.* 6435:10, 1995; Sambrook; Tijssen; Ausubel. Product information from manufacturers of biological reagents and experimental equipment also provide information regarding known biological methods. The vectors can be isolated from natural sources, obtained from such sources as ATCC or GenBank libraries, or prepared by synthetic or recombinant methods.

The nucleic acids can be expressed in expression cassettes, vectors or viruses which are stably or transiently expressed in cells (e.g., episomal expression systems). Selection markers can be incorporated into expression cassettes and vectors to confer a selectable phenotype on transformed cells and sequences. For example, selection markers can code for episomal maintenance and replication such that integration into the host genome is not required. For example, the marker may encode antibiotic resistance (e.g., chloramphenicol, kanamycin, G418, bleomycin, hygromycin) or herbicide resistance (e.g., chlorosulfuron or Basta) to permit selection of those cells transformed with the desired DNA sequences (see, e.g., Blondelet-Rouault, *Gene* 190:315, 1997; Aubrecht, *J. Pharmacol. Exp. Ther.* 281:992, 1997). Because selectable marker genes conferring resistance to substrates like neomycin or hygromycin can only be utilized in tissue culture, chemoresistance genes are also used as selectable markers in vitro and in vivo.

A chimeric nucleic acid sequence may encode a sensant-binding domain within any 7-transmembrane polypeptide. Seven-transmembrane receptors belong to a superfamily of trans-membrane (TM) proteins having seven domains that traverse a plasma membrane seven times. Each of the seven domains spans the plasma membrane (TM I to TM VII). Because 7-trans-membrane receptor polypeptides have similar primary sequences and secondary and tertiary structures, structural domains (e.g., TM domains) can be readily identified by sequence analysis. For example, homology modeling, Fourier analysis and helical periodicity detection can identify and characterize the seven domains with a 7-trans-membrane receptor sequence. Fast Fourier Transform (FFT) algorithms can be used to assess the dominant periods that characterize profiles of the hydrophobicity and variability of analyzed sequences. To predict TM domains and their boundaries and topology, a "neural network algorithm" by "PHD server" can be used, as done by Pilpel, *Protein Science* 8:969, 1999; Rost, *Protein Sci.* 4:521, 1995. Periodicity detection enhancement and alpha helical periodicity index can be done as by, e.g., Donnelly, *Protein Sci.* 2:55-70 (1993). Other alignment and modeling algorithms are well known in the art, see, e.g., Peitsch, *Receptors Channels* 4:161, 1996; Cronet, *Protein Eng.* 6:59, (1993) (homology and "discover modeling"); http://bioinfo.weizmann.ac.il/.

The library sequences include receptor sequences that correspond to TM ligand-binding domains, including, e.g., TM II to VII, TM II to VI, TM III to VII, and TM III to VII, that have been amplified (e.g., PCR) from mRNA of or cDNA derived from, e.g., olfactory receptor-expressing neurons or genomic DNA.

Libraries of sensory receptor ligand-binding TM domain sequences can include a various TM domains or variations thereof, as described above. These sequences can be derived from any 7-transmembrane receptor. Because these polypeptides have similar primary sequences and secondary and tertiary structures, the seven domains can be identified by various analyses well known in the art, including, e.g., homology modeling, Fourier analysis and helical periodicity (see, e.g., Pilpel supra), as described above. Using this information sequences flanking the seven domains can be identified and used to design degenerate primers for amplification of various combinations of TM regions and subsequences.

The present invention also includes not only the DNA and proteins having the specified amino acid sequences, but also DNA fragments, particularly fragments of, for example, 40, 60, 80, 100, 150, 200, or 250 nucleotides, or more, as well as protein fragments of, for example, 10, 20, 30, 50, 70, 100, or 150 amino acids, or more.

Also contemplated are chimeric proteins, comprising at least 10, 20, 30, 50, 70, 100, or 150 amino acids, or more, of one of at least one of the sensory receptors described herein, coupled to additional amino acids representing all or part of another G protein receptor, preferably a member of the 7-transmembrane superfamily. These chimerae can be made from the instant receptors and a G protein receptor described herein, or they can be made by combining two or more of the present proteins. In one preferred embodiment, one portion of the chimera corresponds to and is derived from one or more of the domains of the 7-transmembrane protein described herein, and the remaining portion or portions come from another G protein-coupled receptor. Chimeric receptors are well known in the art, and the techniques for creating them and the selection and boundaries of domains or fragments of G protein-coupled receptors for incorpo-ration therein are also well known. Thus, this knowledge of those skilled in the art can readily be used to create such chimeric receptors. The use of such chimeric receptors can provide, for example, an olfactory selectivity characteristic of one of the receptors specifically disclosed herein, coupled with the signal transduction characteristics of another receptor, such as a well known receptor used in prior art assay systems.

For example, a domain such as a ligand binding domain, an extracellular domain, a transmembrane domain (e.g., one comprising seven transmembrane regions and corresponding extracellular and cytosolic loops), the transmembrane domain and a cytoplasmic domain, an active site, a subunit association region, etc., can be covalently linked to a heterologous protein. For instance, an extracellular domain can be linked to a heterologous GPCR transmembrane domain, or a heterologous CGP CR extracellular domain can be linked to a transmembrane domain. Other heterologous proteins of choice can include, e.g., green fluorescent protein, β-gal, glutamtate receptor, and the rhodopsin presequence.

Polymorphic variants, alleles, and interspecies homologs that are substantially identical to a sensory receptor disclosed herein can be isolated using the nucleic acid probes described above. Alternatively, expression libraries can be used to isolate sensory receptors and polymorphic variants, alleles, and interspecies homologs thereof, by detecting expressed homologs immunologically with antisera or purified antibodies made against a sensory receptor-derived polypeptide, which also recognize and selectively bind to the sensory receptor homolog.

Also within the scope of the invention are host cells for expressing the sensory receptors, fragments, or variants of the invention. To obtain high levels of expression of a cloned gene or nucleic acid, such as cDNAs encoding the sensory receptors, fragments, or variants thereof, the nucleic acid sequence of interest is subcloned into an expression vector that contains a strong promoter to direct transcription, a transcription/translation terminator, and if for a nucleic acid encoding a protein, a ribosome binding site for translational initiation. Suitable prokaryotic and eukaryotic expression systems are well known in the art and described, e.g., in Sambrook et al.

Any of the well known procedures for introducing foreign nucleotide sequences into host cells may be used. These include the use of calcium phosphate transfection, polybrene, protoplast fusion, electroporation, liposomes, microinjection, plasmid vectors, viral vectors and any of the other well known methods for introducing cloned genomic DNA, cDNA, synthetic DNA or other foreign genetic material into a host cell (see, e.g., Sambrook et al.). It is only necessary that the particular genetic engineering procedure used be capable of successfully introducing at lest one gene into the host cell capable of expressing the olfactory receptor, fragment, or variant of interest.

After the expression vector is introduced into the cells, the transfected cells are cultured under conditions favoring expression of the receptor, fragment, or variant of interest, which is then recovered from the culture using standard techniques. Examples of such techniques are well known in the art. See, e.g., WO 00/06593, which is incorporated by reference in a manner consistent with this disclosure.

D. Immunological Detection of Sensory Receptor Polypeptides

In addition to the detection of sensory receptor genes and gene expression using nucleic acid hybridization technology, one can also use immunoassays to detect sensory receptors, e.g., to identify olfactory receptor cells, and variants of sensory receptor family members. Immunoassays can be used to qualitatively or quantitatively analyze the sensory receptors. A general overview of the applicable technology can be found in Harlow & Lane, *Antibodies: A Laboratory Manual* (1988).

1. Antibodies to Sensory Receptor Family Members

Methods of producing polyclonal and monoclonal antibodies that react specifically with a sensory receptor family member are known to those of skill in the art (see, e.g., Coligan, *Current Protocols in Immunology*, 1991; Goding, *Monoclonal Antibodies: Principles and Practice*, 2d ed., 1986; Harlow & Lane, supra; and Kohler & Milstein, *Nature*, 256:495, 1975). Such techniques include antibody preparation by selection of antibodies from libraries of recombinant antibodies in phage or similar vectors, as well as preparation of polyclonal and monoclonal antibodies by immunizing rabbits or mice (see, e.g., Huse et al., *Science*, 246:1275, 1989; Ward et al., *Nature*, 341:544, 1989).

A number of sensory receptor-comprising immunogens may be used to produce antibody specifically reactive with a sensory receptor family member. For example, a recombinant sensory receptor protein, or an antigenic fragment thereof, can be isolated as described herein. Suitable antigenic regions include, e.g., the conserved motifs that are used to identify members of the sensory receptor family. Recombinant proteins can be expressed in eukaryotic or prokaryotic cells as described above, and purified as generally described above. Recombinant protein is the preferred immunogen for the production of monoclonal or polyclonal antibodies. Alternatively, a synthetic peptide derived from the sequences disclosed herein and conjugated to a carrier protein can be used an immunogen. Naturally occurring protein may also be used either in pure or impure form. The product is then injected into an animal capable of producing antibodies. Either monoclonal or polyclonal antibodies may be generated, for subsequent use in immunoassays to measure the protein.

Methods of production of polyclonal antibodies are known to those of skill in the art. Mice, hamsters, rats, guinea pigs, rabbits, goats, or chickens is immunized with the protein using an adjuvant (e.g., Freund's adjuvant) and a standard immunization protocol with periodic boosts. The animal's immune response to the immunogen preparation is monitored by taking test bleeds and determining the titer of reactivity to the sensory receptor. When appropriately high titers of antibody to the immunogen are obtained, blood is collected from the animal and antisera are prepared. Further fractionation of the antisera to enrich for antibodies reactive to the protein can be done if desired (see Harlow & Lane, supra).

Monoclonal antibodies may be obtained by various techniques familiar to those skilled in the art. Briefly, spleen cells from an animal immunized with a desired antigen are immortalized, commonly by fusion with a myeloma cell (see Kohler & Milstein, *Eur. J. Immunol.*, 6:511, 1976). Alternative methods of immortalization include transformation with Epstein Barr Virus, oncogenes, retroviruses, or other methods well known in the art. Colonies arising from single clones of immortalized cells are screened for production of antibodies of the desired specificity and affinity for the antigen, and yield of the monoclonal antibodies produced by such cells may be enhanced by various techniques, including injection into the peritoneal cavity of a vertebrate host. Alternatively, one may isolate DNA sequences which encode a monoclonal antibody or a binding fragment thereof by screening a DNA library from human B cells according to the general protocol outlined by Huse et al., *Science*, 246:1275, 1989.

Monoclonal antibodies or polyclonal sera are collected and titered against antigen in an immuno assay, for example, a solid phase immuno assay with the antigen immobilized on a solid support. Typically, polyclonal antisera with a titer of $10^4$ or greater are selected and tested for their cross reactivity against non-sensory receptor proteins, or even other sensory receptor family members or other related proteins from other organisms, using a competitive binding immuno-assay. Specific polyclonal antisera and monoclonal antibodies will usually bind with a Kd of at least about 0.1 mM, more usually at least about 1 pM, optionally at least about 0.1 p.M or better, and optionally 0.01 pM or better.

Once sensory receptor family member specific antibodies are available, individual sensory receptor proteins can be detected by a variety of immuno assay methods. For a review of immu-nological and immunoassay procedures, see *Basic and Clinical Immunology* (Stites & Terr eds., 7th ed., 199 1). Moreover, the immuno assays of the present invention can be performed in any of several configurations, which are reviewed extensively in *Enzyme Immunoassay* (Maggio, ed., 1980); and Harlow & Lane, supra.

2. Immunological Binding Assays

Sensory receptor proteins can be detected and/or quantified using any of a number of well recognized immunological binding assays (see, e.g., U.S. Pat. Nos. 4,366,241; 4,376,110; 4,517,288; and 4,837,168). For a review of the general immunoassays, see also *Methods in Cell Biology: Antibodies in Cell Biology*, volume 37 (Asai, ed. 1993); *Basic and Clinical Immunology* (Stites & Terr, eds., 7th ed., 1991). Immunological binding assays (or immunoassays) typically use an antibody that specifically binds to a protein or antigen of choice (in this case a sensory receptor family member or an antigenic subsequence thereof). The antibody (e.g., anti-sensory receptor) may be produced by any of a number of means well known to those of skill in the art and as described above.

Immunoassays also often use a labeling agent to specifically bind to and label the complex formed by the antibody and antigen. The labeling agent may itself be one of the moieties comprising the antibody/antigen complex. Thus, the labeling agent may be a labeled sensory receptor polypeptide or a labeled anti-sensory receptor antibody. Alternatively, the labeling agent may be a third moiety, such a secondary antibody, that specifically binds to the antibody/sensory receptor complex (a secondary antibody is typically specific to antibodies of the species from which the first antibody is derived). Other proteins capable of specifically binding immunoglobulin constant regions, such as protein A or protein G may also be used as the label agent. These proteins exhibit a strong non-immunogenic reactivity with immunoglobulin constant regions from a variety of species (see, e.g., Kronval et al., *J. Immunol.*, 111:1401, 1973; Akerstrom et al., *J. Immunol.*, 135:2589, 1985). The labeling agent can be modified with a detectable moiety, such as biotin, to which another molecule can specifically bind, such as streptavidin. A variety of detectable moieties are well known to those skilled in the art.

Throughout the assays, incubation and/or washing steps may be required after each combination of reagents. Incubation steps can vary from about 5 seconds to several hours, optionally from about 5 minutes to about 24 hours. However, the incubation time will depend upon the assay format, antigen, volume of solution, concentrations, and the like. Usually, the assays will be carried out at ambient temperature, although they can be conducted over a range of temperatures, such as 10° C. to 40° C.

a. Non-competitive Assay Formats

Immunoassays for detecting a sensory receptor protein in a sample may be either competi-tive or noncompetitive. Noncompetitive immunoassays directly measure the amount of antigen. In one preferred "sandwich" assay, for example, the anti-sensory receptor antibodies are bound directly to a solid substrate on which they are immobilized. These immobilized antibodies then capture the sensory receptor protein present in the test sample. The sensory receptor protein thus immobilized is then bound by a labeling agent, such as a second anti-sensory receptor antibody bearing a label. Alternatively, the second antibody may lack a label, but it may, in turn, be bound by a labeled third antibody specific to antibodies of the species from which the second antibody is derived. The second or third antibody is typically modified with a detectable moiety, such as biotin, to which another molecule specifically binds, e.g., streptavidin, to provide a detectable moiety.

b. Competitive Assay Formats

In competitive assays, the amount of sensory receptor protein present in the sample is measured indirectly by measuring the amount of a known, added (exogenous) sensory receptor protein displaced (competed away) from an anti-sensory receptor antibody by the unknown sensory receptor protein present in a sample. In one competitive assay, a known amount of sensory receptor protein is added to a sample and the sample is then contacted with an antibody that specifically binds to the sensory receptor. The amount of exogenous sensory receptor protein bound to the antibody is inversely proportional to the concentration of sensory receptor protein present in the sample. In a particularly preferred embodiment, the antibody is immobilized on a solid substrate. The amount of sensory receptor protein bound to the antibody may be determined either by measuring the amount of sensory receptor protein present in a sensory receptor/antibody complex, or alternatively by measuring the amount of remaining uncomplexed protein. The amount of sensory receptor protein may be detected by providing a labeled sensory receptor molecule.

A hapten inhibition assay is another preferred competitive assay. In this assay the known sensory receptor protein is immobilized on a solid substrate. A known amount of anti-sensory receptor antibody is added to the sample, and the sample is then contacted with the immobilized sensory receptor. The amount of anti-sensory receptor antibody bound to the known immobilized sensory receptor protein is inversely proportional to the amount of sensory receptor protein present in the sample. Again, the amount of immobilized antibody may be detected by detecting either the immobilized fraction of antibody or the fraction of the antibody that remains in solution. Detection may be direct where the antibody is labeled or indirect by the subsequent addition of a labeled moiety that specifically binds to the antibody as described above.

c. Cross-reactivity Determinations

Immunoassays in the competitive binding format can also be used for cross-reactivity determinations. For example, a protein at least partially encoded by the nucleic acid sequences disclosed herein can be immobilized to a solid support. Proteins (e.g., sensory receptor proteins and homologs) are added to the assay that compete for binding of the antisera to the immobilized antigen. The ability of the added proteins to compete for binding of the antisera to the immobi-lized protein is compared to the ability of the sensory receptor polypeptide encoded by the nucleic acid sequences disclosed herein to compete with itself. The percentage cross-reactivity for the above proteins is calculated, using standard calculations. Those antisera with less than 10% cross-reactivity with each of the added proteins listed above are selected and pooled. The cross-reacting antibodies are optionally removed from the pooled antisera by immunoabsorption with the added considered proteins, e.g., distantly related homologs. In addition, peptides comprising amino acid sequences representing conserved motifs that are used to identify members of the sensory receptor family can be used in cross-reactivity determinations.

The immunoabsorbed and pooled antisera are then used in a competitive binding immu-noassay as described above to compare a second protein, thought to be perhaps an allele or poly-morphic variant of a sensory receptor family member, to the immunogen protein (i.e., sensory receptor protein encoded by the nucleic acid sequences disclosed herein). In order to make this comparison, the two proteins are each assayed at a wide range of concentrations and the amount of each protein required to inhibit 50% of the binding of the antisera to the immobilized protein is determined. If the amount of the second protein required to inhibit 50% of binding is less than 10 times the amount of the protein encoded by nucleic acid sequences disclosed herein required to inhibit 50% of binding, then the second protein is said to specifically bind to the polyclonal antibodies generated to a sensory receptor immunogen.

Antibodies raised against sensory receptor conserved motifs can also be used to prepare antibodies that specifically bind only to GPCRs of the sensory receptor family, but not to GPCRs from other families. Polyclonal antibodies that specifically bind to a particular member of the sensory receptor family, can be make by subtracting out cross-reactive antibodies using other sensory receptor family members. Species-specific polyclonal antibodies can be made in a similar way. For example, antibodies specific to human T2R01 can be made by, subtracting out antibodies that are cross-reactive with orthologous sequences, e.g., rat OLFR1 or mouse OLFR1.

d. Other Assay Formats

Western blot (immunoblot) analysis is used to detect and quantify the presence of sensory receptor protein in the sample. The technique generally comprises separating sample proteins by gel electrophoresis on the basis of molecular weight, transferring the separated proteins to a suitable solid support, (such as a nitrocellulose filter, a nylon filter, or derivatized nylon filter), and incubating the sample with the antibodies that specifically bind the sensory receptor protein. The anti-sensory receptor polypeptide antibodies specifically bind to the sensory receptor poly-peptide on the solid support. These antibodies may be directly labeled or alternatively may be subsequently detected using labeled antibodies (e.g., labeled sheep anti-mouse antibodies) that specifically bind to the anti-sensory receptor antibodies.

Other assay formats include liposome immunoassays (LIA) using liposomes designed to bind specific molecules (e.g., antibodies) and release encapsulated reagents or markers. The released chemicals are then detected according to standard techniques (see Monroe et al., *Amer. Clin. Prod. Rev.*, 5:34, 1986).

e. Reduction of Non-specific Binding

One of skill in the art will appreciate that it is often desirable to minimize non-specific binding in immunoassays. Particularly, where the assay involves an antigen or antibody immo-bilized on a solid substrate it is desirable to minimize the amount of non-specific binding to the substrate. Means of reducing such non-specific binding are well known to those of skill in the art. Typically, this technique involves coating the substrate with a proteinaceous composition. In particular, protein compositions such as bovine serum albumin (BSA), nonfat powdered milk, and gelatin are widely used with powdered milk being most preferred.

f. Labels

The particular label or detectable group used in the assay is not a critical aspect of the invention, as long as it does not significantly interfere with the specific binding of the antibody used in the assay. The detectable group can be any material having a detectable physical or chemical property. Such detectable labels have been well-developed in the field of immuno-assays and, in general, most any label useful in such methods can be applied to the present invention. Thus, a label is any composition detectable by spectroscopic, photochemical, bio-chemical, immunochemical, electrical, optical or chemical means. Useful labels in the present invention include magnetic beads (e.g., DYNABEADS™, fluorescent dyes (e.g., fluorescein isothiocyanate, Texas red, rhodamine, and the like), radiolabels (e.g.,$^3$H, $^{125}$I, $^{35}$S, $^{14}$C, or $^{32}$P), enzymes (e.g., horseradish peroxidase, alkaline phosphatase and others commonly used in an ELISA), and colorimetric labels such as colloidal gold or colored glass or plastic beads (e.g., polystyrene, polypropylene, latex, etc.).

The label may be coupled directly or indirectly to the desired component of the assay according to methods well known in the art. As indicated above, a wide variety of labels may be used, with the choice of label depending on sensitivity required, ease of conjugation with the compound, stability requirements, available instrumentation, and disposal provisions.

Non-radioactive labels are often attached by indirect means. Generally, a ligand molecule (e.g., biotin) is covalently bound to the molecule. The ligand then binds to another molecules (e.g., streptavidin) molecule, which is either inherently detectable or covalently bound to a signal system, such as a detectable enzyme, a fluorescent compound, or a chemiluminescent compound. The ligands and their targets can be used in any suitable combination with antibodies that recognize a sensory receptor protein, or secondary antibodies that recognize anti-sensory receptor.

The molecules can also be conjugated directly to signal generating compounds, e.g., by conjugation with an enzyme or fluorophore. Enzymes of interest as labels will primarily be hydrolases, particularly phosphatases, esterases and glycosidases, or oxidotases, particularly peroxidases. Fluorescent compounds include fluorescein and its derivatives, rhodamine and its derivatives, dansyl, umbelliferone, etc. Chemiluminescent compounds include luciferin, and 2,3-dihydrophthalazinediones, e.g., luminol. For a review of various labeling or signal producing systems that may be used, see U.S. Pat. No. 4,391,904.

Methods for detecting labels are well known. Thus, for example, where the label is a radioactive label, it may be detected using a scintillation counter or with photographic film as in autoradiography. Where the label is a fluorescent label, it may be detected by exciting the fluoro-chrome with the appropriate wavelength of light and detecting the resulting fluorescence. The fluorescence may be detected visually, with photographic film, or using electronic detectors such as charge coupled devices (CCDs) or photomultipliers. Similarly, enzymatic labels may be detected by providing the appropriate substrates for the enzyme and detecting the resulting reaction product. Finally, simple colorimetric labels may be detected simply by observing the color associated with the label. Thus, in various dipstick assays, conjugated gold often appears pink, while various conjugated beads appear the color of the bead.

Some assay formats do not require the use of labeled components. For instance, aggluti-nation assays can be used to detect the presence of the target antibodies. In this case, antigen-coated particles are agglutinated by samples comprising the target antibodies. In this format, none of the components need be labeled and the presence of the target antibody is detected by simple visual inspection.

E. Detection of Olfactory Modulators

Methods and compositions for determining whether a test compound specifically binds to a mammalian sensory, and more particularly, olfactory receptor of the invention, both in vitro and in vivo are described below, as are methods and compositions for determining whether a test compound is neurotoxic to an olfactory neuron expressing an olfactory transmembrane receptor polypeptide. Any aspect of cell physiology can be monitored to assess the effect of sensant-binding to a naturally-occurring or chimeric olfactory receptor. These assays may be performed on intact cells expressing an olfactory receptor, on permeabilized cells or on membrane fractions produced by standard methods.

Olfactory receptors are normally located on the specialized cilia of olfactory neurons. These receptors bind odorants and initiate the transduction of chemical stimuli into electrical signals. An activated or inhibited G-protein will in turn alter the properties of target enzymes, channels, and other effector proteins. The classic examples are the activation of cGMP phosphodiesterase by transducin in the visual system, adenylate cyclase by the stimulatory G-protein, phospholipase C by Gq and other cognate G-proteins, and modulation of diverse channels by Gi and other G-proteins. Downstream consequences can also be examined such as generation of diacyl glycerol and IP3 by phospholipase C, and in turn, for calcium mobilization by IP3.

The sensory receptor protein of the assay will typically be selected from a natural poly-peptide or conservatively modified variant thereof. Generally, the amino acid sequence identity will be at least 75%, 85%, 90%, 95%, or 99%. Optionally, the polypeptide of the assays can comprise a domain of a sensory receptor protein, such as an extracellular domain, transmembrane region, transmembrane domain, cytoplasmic domain, ligand binding domain, subunit association domain, active site, and the like. Either the sensory receptor protein or a domain thereof can be covalently linked to a heterologous protein to create a chimeric protein used in the assays described herein.

Modulators of sensory receptor activity can be tested using sensory receptor polypeptides as described above, either recombinant or naturally occurring. Protein can be isolated, expressed in a cell, expressed in a membrane derived from a cell, expressed in tissue or in an animal, either recombinant or naturally occurring. Modulation can be tested using one of the in vitro or in vivo assays described herein.

1. In vitro Binding Assays

Sensory perception can also be examined in vitro with soluble or solid state reactions, using a full-length sensory receptor-GPCR or a chimeric molecule such as an extracellular domain or transmembrane region, or combination thereof, of a sensory receptor covalently linked to a heterologous signal transduction domain, or a heterologous extracellular domain and/or transmembrane region covalently linked to the transmembrane and/or cytoplasmic domain of a sensory receptor. Furthermore, ligand-binding domains of the protein of interest can be used in vitro in soluble or solid state reactions to assay for ligand binding. In numerous embodiments, a chimeric receptor will be made that comprises all or part of a sensory receptor polypeptide, as well an additional sequence that facilitates the localization of the sensory receptor to the membrane, such as a rhodopsin, e.g., an N-terminal fragment of a rhodopsin protein.

Ligand binding to a sensory receptor protein, a domain, or chimeric protein can be tested in solution, in a bilayer membrane, attached to a solid phase, in a lipid monolayer, or in vesicles. Binding of a modulator can be tested using, e.g., changes in spectroscopic characteristics (e.g., fluorescence, absorbence, refractive index) hydrodynamic (e.g., shape), chromatographic, or solubility properties. Sensory receptors with large (e.g., approximately 600 amino acid residues) extracellular N-terminal segments. These N-terminal segments are thought to form ligand-binding domains, and are therefore useful in biochemical assays to identify sensory receptor agonists and antagonists. Similar assays have been used with other GPCRs, such as the metabo-tropic glutamate receptors (e.g., Han & Hampson, *J. Biol. Chem.* 274:10008, 1999). These assays might involve displacing a radioactively or fluorescently labeled ligand, and measuring changes in intrinsic fluorescence or changes in proteolytic susceptibility, etc.

Receptor-G-protein interactions can also be examined. For example, binding of the G-protein to the receptor or its release from the receptor can be examined. For example, in the absence of GTP, an activator will lead to the formation of a tight complex of a G protein (all three subunits) with the receptor. This complex can be detected in a variety of ways, as noted above. Such an assay can be modified to search for inhibitors, e.g., by adding an activator to the receptor and G protein in the absence of GTP, which form a tight complex, and then screen for inhibitors by looking at dissociation of the receptor-G protein complex. In the presence of GTP, release of the alpha subunit of the G protein from the other two G protein subunits serves as a criterion of activation.

An activated or inhibited G-protein will in turn alter the properties of target enzymes, channels, and other effector proteins. The classic examples are the activation of cGMP phosphodiesterase by transducin in the visual system, adenylate cyclase by the stimulatory G-protein, phospholipase C by Gq and other cognate G proteins, and modulation of diverse channels by Gi and other G proteins. Downstream consequences can also be examined such as generation of diacyl glycerol and IP3 by phospholipase C, and in turn, for calcium mobilization by IP3.

2. Fluorescence Polarization Assays

In another embodiment, Fluorescence Polarization ("FP") based assays may be used to detect and monitor sensant binding. Fluorescence polarization is a versatile laboratory technique for measuring equilibrium binding, nucleic acid hybridization, and enzymatic activity. Fluores-cence polarization assays are homogeneous in that they do not require a separation step such as centrifugation, filtration, chromatography, precipitation, or electrophoresis. These assays are done in real time, directly in solution and do not require an immobilized phase. Polarization values can be measured repeatedly and after the addition of reagents since measuring the polarization is rapid and does not destroy the sample. Generally, this technique can be used to measure polarization values of fluorophores from low picomolar to micromolar levels. This section describes how fluorescence polarization can be used in a simple and quantitative way to measure the binding of odorants to the sensory receptors of the invention.

When a fluorescently labeled molecule is excited with plane polarized light, it emits light that has a degree of polarization that is inversely proportional to its molecular rotation. Large fluorescently labeled molecules remain relatively stationary during the excited state (4 nano-seconds in the case of fluorescein) and the polarization of the light remains relatively constant between excitation and emission. Small fluorescently labeled molecules rotate rapidly during the excited state and the polarization changes significantly between excitation and emission. There-fore, small molecules have low polarization values and large molecules have high polarization values. For example, a single-stranded fluorescein-labeled oligonucleotide has a relatively low polarization value but when it is hybridized to a complementary strand, it has a higher polariza-tion value. When using FP to detect and monitor odorant-binding which may activate or inhibit the sensory receptors of the invention, fluorescence-labeled sensants or auto-fluorescent sensants may be used. Fluorescence polarization (P) is defined as:

$$P = \frac{Int_\parallel - Int_\perp}{Int_\parallel + Int_\perp}$$

Where $\Pi$ is the intensity of the emission light parallel to the excitation light plane and Int $\perp$ is the intensity of the emission light perpendicular to the excitation light plane. P, being a ratio of light intensities, is a dimensionless number. For example, the Beacon® and Beacon 2000™ System may be used in connection with these assays. Such systems typically express polarization in millipolarization units (1 Polarization Unit=1000 mP Units).

The relationship between molecular rotation and size is described by the Perrin equation and the reader is referred to Jolley *J. Anal. Toxicol.* 5, 236, 1981 which gives a thorough explanation of this equation. Summarily, the Perrin equation states that polarization is directly proportional to the rotational relaxation time, the time that it takes a molecule to rotate through an angle of approximately 68.5°. Rotational relaxation time is related to viscosity ($\eta$), absolute temperature (T), molecular volume (V), and the gas constant (R) by the following equation:

$$\text{Rotational Relaxation Time} = \frac{3\eta V}{RT}$$

The rotational relaxation time is small ($\approx$1 nanosecond) for small molecules (e.g., fluorescein) and large ($\approx$100 nanoseconds) for large molecules (e.g., immunoglobulins). If viscosity and temperature are held constant, rotational relaxation time, and therefore polarization, is directly related to the molecular volume. Changes in molecular volume may be due to inter-actions with other molecules, dissociation, polymerization, degradation, hybridization, or confor-mational changes of the fluorescently labeled molecule. For example, fluorescence polarization has been used to measure enzymatic cleavage of large fluorescein labeled polymers by proteases, DNases, and RNases. It also has been used to measure equilibrium binding for protein/protein interactions, antibody/antigen binding, and protein/DNA binding.

3. Soluble and Solid State High Throughput Assays

In yet another embodiment, the invention provides soluble assays using molecules such as a domain such as ligand binding domain, an extracellular domain, a transmembrane domain (e.g., one comprising seven transmembrane regions and cytosolic loops), the transmembrane domain and a cytoplasmic domain, an active site, a subunit association region, etc.; a domain that is covalently linked to a heterologous protein to create a chimeric molecule; a sensory receptor protein; or a cell or tissue expressing a sensory receptor protein, either naturally occurring or recombinant. In another embodiment, the invention provides solid phase based in vitro assays in a high throughput format, where the domain, chimeric molecule, sensory receptor protein, or cell or tissue expressing the sensory receptor is attached to a solid phase substrate.

In the high throughput assays of the invention, it is possible to screen up to several thousand different modulators or ligands in a single day. In particular, each well of a microtiter plate can be used to run a separate assay against a selected potential modulator, or, if concentration or incubation time effects are to be observed, every 5-10 wells can test a single modulator. Thus, a single standard microtiter plate can assay about 100 (e.g., 96) modulators. If 1536 well plates are used, then a single plate can easily assay from about 1000 to about 1500 different compounds. It is possible to assay several different plates per day; assay screens for up to about 6,000-20,000 different compounds is possible using the integrated systems of the invention. More recently, microfluidic approaches to reagent manipulation have been developed.

The molecule of interest can be bound to the solid state component, directly or indirectly, via covalent or non covalent linkage, e.g., via a tag. The tag can be any of a variety of compo-nents. In general, a molecule which binds the tag (a tag binder) is fixed to a solid support, and the tagged molecule of interest (e.g., the taste transduction molecule of interest) is attached to the solid support by interaction of the tag and the tag binder.

A number of tags and tag binders can be used, based upon known molecular interactions well described in the literature. For example, where a tag has a natural binder, for example, biotin, protein A, or protein G, it can be used in conjunction with appropriate tag binders (avidin, streptavidin, neutravidin, the Fc region of an immunoglobulin, etc.). Antibodies to molecules with natural binders such as biotin are also widely available and appropriate tag binders (see, SIGMA Immunochemicals 1998 catalogue SIGMA, St. Louis Mo.).

Similarly, any haptenic or antigenic compound can be used in combination with an appro-priate antibody to form a tag/tag binder pair. Thousands of specific antibodies are commercially available and many additional antibodies are described in the literature. For example, in one common configuration, the tag is a first antibody and the tag binder is a second antibody which recognizes the first antibody. In addition to antibody-antigen interactions, receptor-ligand inter-actions are also appropriate as tag and tag-binder pairs. For example, agonists and antagonists of cell membrane receptors (e.g., cell receptor-ligand interactions such as transferrin, c-kit, viral receptor ligands, cytokine receptors, chemokine receptors, interleukin receptors, immunoglobulin receptors and antibodies, the cadherein family, the integrin family, the selectin family, and the like; see, e.g., Pigott & Power, *The Adhesion Molecule Facts Book I* 1993). Similarly, toxins and venoms, viral epitopes, hormones (e.g., opiates, steroids, etc.), intracellular receptors (e.g., which mediate the effects of various small ligands, including steroids, thyroid hormone, retinoids and vitamin D; peptides), drugs, lectins, sugars, nucleic acids (both linear and cyclic polymer configurations), oligosaccharides, proteins, phospholipids and antibodies can all interact with various cell receptors.

Synthetic polymers, such as polyurethanes, polyesters, polycarbonates, polyureas, poly-amides, polyethyleneimines, polyarylene sulfides, polysiloxanes, polyimides, and polyacetates can also form an appropriate tag or tag binder. Many other tag/tag binder pairs are also useful in assay systems described herein, as would be apparent upon review of this disclosure.

Common linkers such as peptides, polyethers, and the like can also serve as tags, and include polypeptide sequences, such as poly gly sequences of between about 5 and 200 amino acids. Such flexible linkers are known to persons of skill in the art. For example, poly(ethelyne glycol) linkers are available from Shearwater Polymers (Huntsville, Ala.). The linkers optionally have amide linkages, sulfhydryl linkages, or heterofunctional linkages.

Tag binders are fixed to solid substrates using any of a variety of methods currently available. Solid substrates are commonly derivatized or functionalized by exposing all or a por-tion of the substrate to a chemical reagent which fixes a chemical group to the surface which is reactive with a portion of the tag binder. For example, groups which are suitable for attachment to a longer chain portion would include amines, hydroxyl, thiol, and carboxyl groups. Amino-alkylsilanes and hydroxyalkylsilanes can be used to functionalize a variety of surfaces, such as glass surfaces. The construction of such solid phase biopolymer arrays is well described in the literature. See, e.g., Merrifield, *J. Am. Chem. Soc.* 85:2149, 1963 (describing solid phase syn-thesis of, e.g., peptides); Geysen et al., *J. Immun. Meth.* 102:259, 1987 (describing synthesis of solid phase components on pins); Frank & Doring, *Tetrahedron* 44:6031, 1988 (describing syn-thesis of various peptide sequences on cellulose disks); Fodor et al., *Science* 251:767, 1991; Sheldon et al., *Clinical Chemistry* 39:718, 1993; and Kozal et al., *Nature Medicine,* 2:753, 1996 (all describing arrays of biopolymers fixed to solid substrates). Non-chemical approaches for fixing tag binders to substrates include other common methods, such as heat, cross-linking by UV radiation, and the like.

4. Computer-based Assays

Yet another assay for compounds that modulate sensory receptor protein activity involves computer assisted drug design, in which a digital or analog processing system is used to generate a three-dimensional structure of a sensory receptor protein based on the structural information encoded by its amino acid sequence. The input amino acid sequence interacts directly and actively with a preestablished algorithm in a computer program to yield secondary, tertiary, and quaternary structural models of the protein. The models of the protein structure are then examined to identify regions of the structure that have the ability to bind, e.g., ligands. These regions are then used to identify ligands that bind to the protein.

The three-dimensional structural model of the protein is generated by entering protein amino acid sequences of at least 10 amino acid residues or corresponding nucleic acid sequences encoding a sensory receptor polypeptide into the computer system. The nucleotide sequence encoding the polypeptide, or the amino acid sequence thereof, can be any of those described herein, or fragments or variants thereof.

The amino acid sequence represents the primary sequence or subsequence of the protein, which encodes the structural information of the protein. At least 10 residues of the amino acid sequence (or a nucleotide sequence encoding 10 amino acids) are entered into the computer system from computer keyboards, computer readable substrates that include, but are not limited to, electronic storage media (e.g., magnetic diskettes, tapes, cartridges, and chips), optical media (e.g., CD ROM), information distributed by Internet sites, and by RAM. The three-dimensional structural model of the protein is then generated by the interaction of the amino acid sequence and the computer system, using software known to those of skill in the art.

The amino acid sequence represents a primary structure that encodes the information necessary to form the secondary, tertiary and quaternary structure of the protein of interest. The software looks at certain parameters encoded by the primary sequence to generate the structural model. These parameters are referred to as "energy terms," and primarily include electrostatic potentials, hydrophobic potentials, solvent accessible surfaces, and hydrogen bonding. Secon-dary energy terms include van der Waals potentials. Biological molecules form the structures that minimize the energy terms in a cumulative fashion. The computer program is therefore using these terms encoded by the primary structure or amino acid sequence to create the secon-dary structural model.

The tertiary structure of the protein encoded by the secondary structure is then formed on the basis of the energy terms of the secondary structure. The user at this point can enter addi-tional variables such as whether the protein is membrane bound or soluble, its location in the body, and its cellular location, e.g., cytoplasmic, surface, or nuclear. These variables along with the energy terms of the secondary structure are used to form the model of the tertiary structure. In modeling the tertiary structure, the computer program matches hydrophobic faces of secondary structure with like, and hydrophilic faces of secondary structure with like.

Once the structure has been generated, potential ligand binding regions are identified by the computer system. Three-dimensional structures for potential ligands are generated by entering amino acid or nucleotide sequences or chemical formulas of compounds, as described above. The three-dimensional structure of the potential ligand is then compared to that of the sensory receptor protein to identify ligands that bind to the protein. Binding affinity between the protein and ligands is determined using energy terms to determine which ligands have an enhanced probability of binding to the protein.

Computer systems are also used to screen for mutations, polymorphic variants, alleles and interspecies homologs of sensory receptor genes. Such mutations can be associated with disease states or genetic traits. As described above, GeneChip™ and related technology can also be used to screen for mutations, polymorphic variants, alleles and interspecies homologs. Once the variants are identified, diagnostic assays can be used to identify patients having such mutated genes. Identification of the mutated sensory receptor genes involves receiving input of a first nucleic acid or amino acid sequence of a sensory receptor gene, or conservatively modified versions thereof. The sequence is entered into the computer system as described above. The first nucleic acid or amino acid sequence is then compared to a second nucleic acid or amino acid sequence that has substantial identity to the first sequence. The second sequence is entered into the computer system in the manner described above. Once the first and second sequences are compared, nucleotide or amino acid differences between the sequences are identified. Such sequences can represent allelic differences in various sensory receptor genes, and mutations associated with disease states and genetic traits.

5. Cell-based Binding Assays

In a preferred embodiment, a sensory receptor polypeptide is expressed in a eukaryotic cell as a chimeric receptor with a heterologous, chaperone sequence that facilitates its maturation and targeting through the secretory pathway. In a preferred embodiment, the heterologous sequence is a rhodopsin sequence, such as an N-terminal fragment of a rhodopsin. Such chimeric sensory receptors can be expressed in any eukaryotic cell, such as HEK-293 cells. Preferably, the cells comprise a functional G protein, e.g., Gα15, that is capable of coupling the chimeric receptor to an intracellular signaling pathway or to a signaling protein such as phospholipase C. Activation of such chimeric receptors in such cells can be detected using any standard method, such as by detecting changes in intracellular calcium by detecting FURA-2 dependent fluorescence in the cell.

Activated GPCR receptors become substrates for kinases that phosphorylate the C-terminal tail of the receptor (and possibly other sites as well). Thus, activators will promote the transfer of 32P from gamma-labeled GTP to the receptor, which can be assayed with a scintillation counter. The phosphorylation of the C-terminal tail will promote the binding of arrestin-like proteins and will interfere with the binding of G-proteins. The kinase/arrestin pathway plays a key role in the desensitization of many GPCR receptors. For example, compounds that modulate the duration an olfactory receptor stays active would be useful as a means of prolonging a desired odor or cutting off an unpleasant one. For a general review of GPCR signal transduction and methods of assaying signal transduction, see, e.g., *Methods in Enzymology*, vols. 237 and 238 (1994) and volume 96 (1983); Bourne et al., *Nature*, 10:349:117-27 (1991); Bourne et al., *Nature*, 348:125-32 (1990); Pitcher et al., *Annu. Rev. Biochem.*, 67:653-92 (1998).

Samples or assays that are treated with a potential sensory receptor protein inhibitor or activator are compared to control samples without the test compound, to examine the extent of modulation. Such assays may be carried out in the presence of an odorant that is known to activate the particular receptor, and modulation of the odorant dependent activation monitored. Control samples (untreated with activators or inhibitors) are assigned a relative sensory receptor activity value of 100. Inhibition of a sensory receptor protein is achieved when the sensory receptor activity value relative to the control is about 90%, optionally 50%, optionally 25-0%. Activation of a sensory receptor protein is achieved when the sensory receptor activity value relative to the control is 110%, optionally 150%, 200-500%, or 1000-2000%.

Changes in ion flux may be assessed by determining changes in polarization (i.e., electri-cal potential) of the cell or membrane expressing a sensory receptor protein. One means to deter-mine changes in cellular polarization is by measuring changes in current, and thereby measuring changes in polarization, with voltage-clamp and patch-clamp techniques, e.g., the "cell-attached" mode, the "inside-out" mode, and the "whole cell" mode (see, e.g., Ackerman et al., *New Engl. J Med.*, 336:1575, 1997). Whole cell currents are conveniently determined using the standard. Other known assays include: assays to measure ion flux using radiolabeled or fluorescent probes such as voltage-sensitive dyes (see, e.g., Vestergarrd-Bogind et al., *J. Membrane Biol.*, 88:67, 1988; Gonzales & Tsien, *Chem. Biol.*, 4:269, 1997; Daniel et al., *J. Pharmacol. Meth.*, 25:185, 1991; Holevinsky et al., *J. Membrane Biology*, 137:59, 1994). Generally, the compounds to be tested are present in the range from 1 pM to 100 mM.

The effects of the test compounds upon the function of the polypeptides can be measured by examining any of the parameters described above. Any suitable physiological change that affects GPCR activity can be used to assess the influence of a test compound on the polypeptides of this invention. When the functional consequences are determined using intact cells or animals, one can also measure a variety of effects such as transmitter release, hormone release, transcriptional changes to both known and uncharacterized genetic markers (e.g., Northern blots), changes in cell metabolism such as cell growth or pH changes, and changes in intracellular second messengers such as $Ca^{2+}$, IP3, cGMP, or cAMP.

Preferred assays for G-protein coupled receptors include cells that are loaded with ion or voltage sensitive dyes to report receptor activity. Assays for determining activity of such receptors can also use known agonists and antagonists for other G-protein coupled receptors as negative or positive controls to assess activity of tested compounds. In assays for identifying modulatory compounds (e.g., agonists, antagonists), changes in the level of ions in the cytoplasm or membrane voltage will be monitored using an ion sensitive or membrane voltage fluorescent indicator, respectively. Among the ion-sensitive indicators and voltage probes that may be employed are those disclosed in the Molecular Probes 1997 Catalog. For G-protein coupled receptors, promiscuous G-proteins such as Gα15 and Gα16 can be used in the assay of choice (Wilkie et al., *Proc. Natl. Acad. Sci.*, 88:10049, 1991). Such promiscuous G-proteins allow coupling of a wide range of receptors.

Receptor activation typically initiates subsequent intracellular events, e.g., increases in second messengers such as IP3, which releases intracellular stores of calcium ions. Activation of some G-protein coupled receptors stimulates the formation of inositol triphosphate (IP3) through phospholipase C-mediated hydrolysis of phosphatidylinositol (Berridge & Irvine, *Nature* 312:315, 1984). IP3 in turn stimulates the release of intracellular calcium ion stores. Thus, a change in cytoplasmic calcium ion levels, or a change in second messenger levels such as IP3 can be used to assess G-protein coupled receptor function. Cells expressing such G-protein coupled receptors may exhibit increased cytoplasmic calcium levels as a result of contribution from both intracellular stores and via activation of ion channels, in which case it may be desirable although not necessary to conduct such assays in calcium-free buffer, optionally supplemented with a chelating agent such as EGTA, to distinguish fluorescence response resulting from calcium release from internal stores.

Other assays can involve determining the activity of receptors which, when activated, result in a change in the level of intracellular cyclic nucleotides, e.g., cAMP or cGMP, by activating or inhibiting enzymes such as adenylate cyclase. There are cyclic nucleotide-gated ion channels, e.g., rod photoreceptor cell channels and olfactory neuron channels that are permeable to cations upon activation by binding of cAMP or cGMP (see, e.g., Altenhofen et al., *Proc. Natl. Acad. Sci.*, 88:9868, 1991 and Dhallan et al., *Nature* 347:184, 1990). In cases where activation of the receptor results in a decrease in cyclic nucleotide levels, it may be preferable to expose the cells to agents that increase intracellular cyclic nucleotide levels, e.g., forskolin, prior to adding a receptor-activating compound to the cells in the assay. Cells for this type of assay can be made by co-transfection of a host cell with DNA encoding a cyclic nucleotide-crated ion channel, GPCR phosphatase and DNA encoding a receptor (e.g., certain glutamate receptors, muscarinic acetylcholine receptors, dopamine receptors, serotonin receptors, and the like), which, when activated, causes a change in cyclic nucleotide levels in the cytoplasm.

In a preferred embodiment, sensory receptor protein activity is measured by expressing a sensory receptor gene in a heterologous cell with a promiscuous G-protein that links the receptor to a phospholipase C signal transduction pathway (see Offermanns & Simon, *J. Biol. Chem.*, 270: 15175, 1995). Optionally the cell line is HEK-293 (which does not naturally express sensory receptor genes) and the promiscuous G-protein is Gal 5 (Offermanns & Simon, supra). Modu-lation of olfactory transduction is assayed by measuring changes in intracellular $Ca^{2+}$ levels, which change in response to modulation of the sensory receptor signal transduction pathway via administration of a molecule that associates with a sensory receptor protein. Changes in $Ca^{2+}$ levels are optionally measured using fluorescent $Ca^{2+}$ indicator dyes and fluorometric imaging.

In one embodiment, the changes in intracellular cAMP or cGMP can be measured using immunoassays. The method described in Offermanns & Simon,*J. Biol. Chem.*, 270: 15175, 1995, may be used to determine the level of cAMP. Also, the method described in Felley-Bosco et al., *Am. J. Resp. Cell and Mol Biol.*, 11: 159, 1994, may be used to determine the level of cGMP. Further, an assay kit for measuring cAMP and/or cGMP is described in U.S. Pat. No. 4,115,538, herein incorporated by reference.

In another embodiment, phosphatidyl inositol (PI) hydrolysis can be analyzed according to U.S. Pat. No. 5,436,128, herein incorporated by reference. Briefly, the assay involves labeling of cells with 3H-myoinositol for 48 or more hrs. The labeled cells are treated with a test compound for one hour. The treated cells are lysed and extracted in chloroform-methanol-water after which the inositol phosphates were separated by ion exchange chromatography and quantified by scintillation counting. Fold stimulation is determined by calculating the ratio of cpm in the presence of agonist, to cpm in the presence of buffer control. Likewise, fold inhibition is determined by calculating the ratio of cpm in the presence of antagonist, to cpm in the presence of buffer control (which may or may not contain an agonist).

In another embodiment, transcription levels can be measured to assess the effects of a test compound on signal transduction. A host cell containing a sensory receptor protein of interest is contacted with a test compound for a sufficient time to effect any interactions, and then the level of gene expression is measured. The amount of time to effect such interactions may be empirically determined, such as by running a time course and measuring the level of transcription as a function of time. The amount of transcription may be measured by using any method known to those of skill in the art to be suitable. For example, mRNA expression of the protein of interest may be detected using northern blots or their polypeptide products may be identified using immunoassays. Alternatively, transcription based assays using reporter gene may be used as described in U.S. Pat. No. 5,436,128, herein incorporated by reference. The reporter genes can be, e.g., chloramphenicol acetyltransferase, luciferase, '3-galactosidase and alkaline phosphatase. Furthermore, the protein of interest can be used as an indirect reporter via attachment to a second reporter such as green fluorescent protein (see, e.g., Mistili & Spector, *Nature Biotech.* 15:961, 1997).

The amount of transcription is then compared to the amount of transcription in either the same cell in the absence of the test compound, or it may be compared with the amount of transcription in a substantially identical cell that lacks the sensory receptor protein of interest. A substantially identical cell may be derived from the same cells from which the recombinant cell was prepared but which had not been modified by introduction of heterologous DNA. Any difference in the amount of transcription indicates that the test compound has in some manner altered the activity of the sensory receptor protein of interest.

6. Transgenic Non-human Animals Expressing Sensory Receptors

Non-human animals expressing one or more sensory receptor sequences of the invention, particularly human olfactory receptor sequences, can also be used for receptor assays. Such expression can be used to determine whether a test compound specifically binds to a mammalian olfactory transmembrane receptor polypeptide in vivo by contacting a non-human animal stably or transiently transfected with a nucleic acid encoding an olfactory receptor or ligand binding region thereof with a test compound and determining whether the animal reacts to the test compound by specifically binding to the receptor polypeptide.

Use of translocation domains in the fusion polypeptides generates a cell expressing high levels of olfactory receptor. Animals transfected or infected with the vectors of the invention are particularly useful for assays to identify and characterize odorants/ligands that can bind to a specific or sets of receptors. Such vector-infected animals expressing libraries of human olfactory sequences can be used for in vivo screening of odorants and their effect on, e.g., cell physiology (e.g., on olfactory neurons), on the CNS (e.g., olfactory bulb activity), or behavior.

Means to infect/express the nucleic acids and vectors, either individually or as libraries, are well known in the art. A variety of individual cell, organ or whole animal parameters can be measured by a variety of means. For example, recording of stimulant-induced waves (bulbar responses) from the main olfactory bulb or accessory olfactory bulb is a useful tool for measuring quantitative stable olfactory responses. When electrodes are located on the olfactory bulb surface it is possible to record stable responses over a period of several days (see, e.g., Kashiwayanagi, *Brain Res. Protoc.* 1:287, 1997). In this study, electroolfactogram recordings were made with a four-electrode assembly from the olfactory epithelium overlying the endoturbinate bones facing the nasal septum. Four electrodes were fixed along the dorsal-to-ventral axis of one turbinate bone or were placed in corresponding positions on four turbinate bones and moved together up toward the top of the bone. See also, Scott, *J. Neurophysiol.* 77:1950, 1997; Scott, *J. Neuro-physiol.* 75:2036, 1996; Ezeh, *J. Neurophysiol.* 73:2207, 1995. In other systems, fluorescence changes in nasal epithelium can be measured using the dye di-4-ANEPPS, which is applied on the rat's nasal septum and medial surface of the turbinates (see, e.g., Youngentob, *J. Neuro-physiol.* 73:387, 1995). Extracellular potassium activity (aK) measurements can also be carried out in in vivo. An increase in aK can be measured in the mucus and the proximal part of the nasal epithelium (see, e.g., Khayari, *Brain Res.* 539:1, 1991).

The sensory receptor sequences of the invention can be for example expressed in animal nasal epithelium by delivery with an infecting agent, e.g., adenovirus expression vector. Recom-binant adenovirus-mediated expression of a recombinant gene in olfactory epithelium using green fluorescent protein as a marker is described by, e.g., Touhara, *Proc. Natl. Acad. Sci. USA* 96:4040, 1999.

The endogenous olfactory receptor genes can remain functional and wild-type (native) activity can still be present. In other situations, where it is desirable that all olfactory receptor activity is by the introduced exogenous hybrid receptor, use of a knockout line is preferred. Methods for the construction of non-human transgenic animals, particularly transgenic mice, and the selection and preparation of recombinant constructs for generating transformed cells are well known in the art.

Construction of a "knockout" cell and animal is based on the premise that the level of expression of a particular gene in a mammalian cell can be decreased or completely abrogated by introducing into the genome a new DNA sequence that serves to interrupt some portion of the DNA sequence of the gene to be suppressed. Also, "gene trap insertion" can be used to disrupt a host gene, and mouse embryonic stem (ES) cells can be used to produce knockout transgenic animals (see, e.g., Holzschu, *Transgenic Res* 6:97, 1997). The insertion of the exogenous is typically by homologous recombination between complementary nucleic acid sequences. The exogenous sequence is some portion of the target gene to be modified, such as exonic, intronic or transcriptional regulatory sequences, or any genomic sequence which is able to affect the level of the target gene's expression; or a combination thereof. Gene targeting via homologous recombination in pluripotential embryonic stem (ES) cells allows one to modify precisely the genomic sequence of interest. Any technique can be used to create, screen for, propagate, a knockout animal, e.g., see Bijvoet, *Hum. Mol. Genet.* 7:53, 1998); Moreadith, *J. Mol. Med.* 75:208, 1997; Tojo, *Cytotechnology* 19:161, 1995; Mudgett, *Methods Mol. Biol.* 48:167, 1995; Longo, *Transgenic Res.* 6:321, 1997; U.S. Pat. Nos. 5,616,491; 5,464,764; 5,631,153; 5,487,992; 5,627,059; 5,272,071; WO 91/09955; WO 93/09222; WO 96/29411; WO 95/31560; WO 91/12650.

The nucleic acid libraries can also be used as reagents to produce "knockout" human cells and their progeny.

F. Modulators

The compounds tested as modulators of a sensory receptor family member can be any small chemical compound, or a biological entity, such as a protein, sugar, nucleic acid or lipid. Alternatively, modulators can be genetically altered versions of a sensory receptor gene. Typically, test compounds will be small chemical molecules and peptides. Essentially any chemical compound can be used as a potential modulator or ligand in the assays of the invention, although most often compounds-can be dissolved in aqueous or organic (especially DMSO-based) solutions are used. The assays are designed to screen large chemical libraries by automating the assay steps and providing compounds from any convenient source to assays, which are typically run in parallel (e.g., in microtiter formats on microtiter plates in robotic assays). It will be appreciated that there are many suppliers of chemical compounds, including Sigma (St. Louis, Mo.), Aldrich (St. Louis, Mo.), Sigma-Aldrich (St. Louis, Mo.), Fluka Chemika-Biochemica Analytika (Buchs, Switzerland) and the like.

In one preferred embodiment, high throughput screening methods involve providing a combinatorial chemical or peptide library containing a large number of potential therapeutic compounds (potential modulator or ligand compounds). Such "combinatorial chemical libraries" or "ligand libraries" are then screened in one or more assays, as described herein, to identify those library members (particular chemical species or subclasses) that display a desired characteristic activity. The compounds thus identified can serve as conventional "lead compounds" or can themselves be used as potential or actual therapeutics.

A combinatorial chemical library is a collection of diverse chemical compounds generated by either chemical synthesis or biological synthesis, by combining a number of chemical "building blocks" such as reagents. For example, a linear combinatorial chemical library such as a polypeptide library is formed by combining a set of chemical building blocks (amino acids) in every possible way for a given compound length (i.e., the number of amino acids in a polypeptide compound). Millions of chemical compounds can be synthesized through such combinatorial mixing of chemical building blocks.

Preparation and screening of combinatorial chemical libraries is well known to those of skill in the art. Such combinatorial chemical libraries include, but are not limited to, peptide libraries (see, e.g., U.S. Pat. No. 5,010,175; Furka, *Int. J. Pept. Prot. Res.* 37:487, 1991; and Houghton et al., *Nature* 354:84, 1991). Other chemistries for generating chemical diversity libraries can also be used. Such chemistries include, but are not limited to: peptoids (e.g., WO 91/19735), encoded peptides (e.g., WO 93/20242), random bio-oligomers (e.g., WO 92/00091), benzodiazepines (e.g., U.S. Pat. No. 5,288,514), diversomers such as hydantoins, benzodiaze-pines and dipeptides (Hobbs et al., *Proc. Nat. Acad. Sci.* 90:6909, 1993), vinylogous polypeptides (Hagihara et al, *J. Amer. Chem. Soc.* 114:6568, 1992), nonpeptidal peptidomimetics with glucose scaffolding (Hirschmann et al., *J. Amer. Chem. Soc.* 114:9217, 1992), analogous organic syntheses of small compound libraries (Chen et al., *J. Amer. Chem. Soc.* 116:2661, 1994), oligo-carbamates (Cho et al., *Science* 261:1303, 1993), peptidyl phosphonates (Campbell et al., *J. Org. Chem.* 59:658, 1994), nucleic acid libraries (Ausubel, Berger and Sambrook, all supra), peptide nucleic acid libraries (U.S. Pat. No. 5,539, 083), antibody libraries (Vaughn et al., *Nature Biotechnology* 14:309, 1996 and WO 97/00271), carbohydrate libraries (Liang et al., *Science* 274:1520, 1996) and U.S. Pat. No. 5,593,853), small organic molecule libraries (benzodiazepines, Baum, *C&EN*, page 33, Jan. 18, 1993); thiazolidinones and metathiazanones, U.S. Pat. No. 5,549,974; pynrolidines, U.S. Pat. Nos. 5,525,735 and 5,519,134; morpholino compounds, U.S. Pat. No. 5,506,337; benzodiazepines, U.S. Pat. No. 5,288,514, and the like.

Devices for the preparation of combinatorial libraries are commercially available (see, e.g., 357 MPS, 390 MPS (Advanced Chem Tech, Louisville, Ky.), Symphony (Rainin, Woburn, Mass.), 433A (Applied Biosystems, Foster City, Calif.), 9050 Plus (Millipore, Bedford, Mass.)). In addition, numerous combinatorial libraries are themselves commercially available (see, e.g., ComGenex, Princeton, N.J.; Tripos, Inc., St. Louis, Mo.; 3D Pharmaceuticals, Exton, Pa.; Martek Biosciences; Columbia, Md.; etc.).

G. Methods for Representing and Predicting Sensant Perception

The invention also preferably provides methods for representing the perception of odor (or taste) and/or for predicting the perception of odor (or taste) in a mammal (e.g., human). Pre-ferably, such methods may be performed by using the receptors and genes encoding the sensory receptors disclosed herein, or fragments or variants thereof.

Also provided is a method of screening a chemical sample for the presence of an odor or taste sensed by a mammal (e.g., human), comprising: contacting the chemical sample with one or more of the aforementioned products and detecting binding between sensant ligand and sensory receptor. The sensory receptor, or fragments or variants thereof (e.g., fusion proteins with repor-ters, chimeric proteins) may be expressed in cells; otherwise, ligand-binding domain(s) may be fixed to a substrate (e.g., substantially planar, bead, or fiber) that is solid or porous. The product used in this method is considered a biosensor.

Moreover, a method is provided for simulating a fragrance or flavor sensed by a mammal (e.g., human), comprising: for each of a plurality of sensory receptors, or fragments or variants thereof, ascertaining the extent to which the sensory receptor interacts with the fragrance and/or flavor; and combining a plurality of compounds, each having a previously-determined interaction with one or more of the sensory receptors, in amounts that together provide a stimulation profile that mimics the profile for the fragrance and/or flavor. Interaction of a fragrance and/or flavor with a sensory receptor can be determined using any of the binding or reporter assays described herein. The interactions can be aggregated or a profile generated using known signal processing techniques (e.g., a neural network) as described below. The sensory receptor, or fragments or variants thereof (e.g., fusion proteins with reporters, chimeric proteins) may be expressed in cells; otherwise, ligand-binding domain(s) may be fixed to a substrate (e.g., planar, bead, or fiber) that is solid or porous. The plurality of compounds may then be combined to form a mixture. If desired, one or more of the plurality of the compounds can be combined covalently. The combined compounds substantially stimulate at least 50%, 60%, 70%, 75%, 80%, 90%, 95%, 99% or all of the receptors that are substantially stimulated by the fragrance or flavor.

In yet another aspect of the invention, a method is provided in which a plurality of standard compounds are tested against a plurality of sensory receptors, or fragments or variants thereof, to ascertain the extent to which the sensory receptors each interact with each standard compound, thereby generating a receptor stimulation profile for each standard compound. These receptor stimulation profiles may then be stored in a relational database on data storage medium. The method may further comprise providing a desired receptor-stimulation profile for an odor and/or taste; comparing the desired receptor stimulation profile to the relational database; and ascertaining one or more combinations of standard compounds that most closely match the desired receptor-stimulation profile. The method may further comprise combining standard compounds in one or more of the ascertained combinations to simulate the odor and/or taste.

A further aspect of the invention is to provide a method for representing sensory percep-tion of a particular odor and/or taste in a mammal (e.g., human), comprising: providing values $X_1$ to $X_n$ representative of the quantitative stimulation of each of n sensory receptors of the mammal; where n is greater than or equal to 5, n is greater than or equal to 10, n is greater than or equal to 20, n is greater than or equal to 50, n is greater than or equal to 75, n is greater than or equal to 100, n is greater than or equal to 125, n is greater than or equal to 150, n is greater than or equal to 175, n is greater than or equal to 200, n is greater than or equal to 225, n is greater than or equal to 250, n is greater than or equal to 275, n is greater than or equal to 300, n is greater than or equal to 325, or n is greater than or equal to 350; and generating from the values a quantitative representation of sensory perception. The sensory receptors may be a receptor disclosed herein, or fragments or variants thereof. The representation may constitute a point or a volume in n-dimensional space, may constitute a graph or a spectrum, or may constitutes a matrix of quantitative representations. Also, the providing step may comprise contacting a plurality of recombi-nantly-produced sensory receptors, or fragments or variants thereof, with a composition and quantitatively measuring the interaction of the composition with the receptors. The maximum number of taste receptors that are needed to mimic the native repertoire (e.g., about 50) may be less than the maximum number of olfactory receptors that are needed (e.g., about 350). But the number of sensory receptors that need to be represented in an assay to provide useful results may be much less.

It is yet another aspect of the invention to provide a method for predicting the sensory perception in a mammal (e.g., human) generated by one or more molecules or combinations of molecules yielding unknown olfactory perception in the mammal, comprising: providing values $X_1$ to $X_n$ representative of the quantitative stimulation of each of n sensory receptors of the mammal; where n is greater than or equal to 5, n is greater than or equal to 10, n is greater than or equal to 20, n is greater than or equal to 50, n is greater than or equal to 75, n is greater than or equal to 100, n is greater than or equal to 125, n is greater than or equal to 150, n is greater than or equal to 175, n is greater than or equal to 200, n is greater than or equal to 225, n is greater than or equal to 250, n is greater than or equal to 275, n is greater than or equal to 300, n is greater than or equal to 325, or n is greater than or equal to 350; for one or more molecules or combinations of molecules yielding known sensory perception in a mammal; and generating from the values a quantitative representation of sensory perception in a mammal for the one or more molecules or combinations of molecules yielding known sensory perception in a mammal, providing values $X_1$ to $X_n$ representative of the quantitative stimulation of each of n sensory receptors of the mammal; where n is greater than or equal to 5, n is greater than or equal to 10, n is greater than or equal to 20, n is greater than or equal to 50, n is greater than or equal to 75, n is greater than or equal to 100, n is greater than or equal to 125, n is greater than or equal to 150, n is greater than or equal to 175, n is greater than or equal to 200, n is greater than or equal to 225, n is greater than or equal to 250, n is greater than or equal to 275, n is greater than or equal to 300, n is greater than or equal to 325, or n is greater than or equal to 350; for one or more mole-cules or combinations of molecules yielding unknown sensory perception in a mammal; and generating from the values a quantitative representation of sensory perception in a mammal for the one or more molecules or combinations of molecules yielding unknown sensory perception in a mammal, and predicting the olfactory perception in a mammal generated by one or more molecules or combinations of molecules yielding unknown sensory perception in a mammal by comparing the quantitative representation of sensory perception in a mammal for the one or more molecules or combinations of molecules yielding unknown sensory perception in a mammal to the quantitative representation of sensory perception in a mammal for the one or more molecules or combinations of molecules yielding known sensory perception in a mammal. The sensory receptors used in this method may include a receptor disclosed herein, or fragment or variant thereof. The maximum number of taste receptors that are needed to mimic the native repertoire (e.g., about 50) may be less than the maximum number of olfactory receptors that are needed (e.g., about 350). But the number of sensory receptors that need to be represented in an assay to provide useful results may be much less.

Assaying for ligand-receptor binding in a large set of sensory receptors is envisioned to mimic the function of the nose or tongue in sensory perception of chemical sensants. For a set of sensory receptors with a redundancy of ligand-binding domains, the resultant signal is a summa-tion of the interactions of all sensory receptors in the set: none, one, or a few of which have ligand-binding domains that are a perfect fit for the sensant; some of which have ligand-binding domains that are only an imperfect fit for the sensant; and most of which do not significantly bind to the sensant. The individual sensory receptor's binding affinity for sensant varies accordingly. Thus, a suitably large set of ligand-binding domains from sensory receptors will be analogous to any ability of the native repertoire of olfactory or taste receptors to tolerate varying degrees of mismatch between ligand and ligand-binding domain. The complication of desensiti-zation of sensory receptor signaling will also be avoided by using the invention instead of preparations of nasal or tongue epithelium containing native sensory receptors. For example, the event of binding between ligand and receptor can be separated from more complicated downstream signaling events in the epithelial cells. But the latter events can be reconstituted in the invention by transferring the sensory receptor of interest into appropriate host cells containing an intact and functional signaling pathway.

H. Administration of Novel Sensant Compositions

Sensory modulators can be administered directly to a mammal (e.g., human) for modu-lation of sensory perception in vivo. Administration is by any of the routes normally used for introducing a modulator compound into ultimate contact with the tissue to be treated (e.g., nose or tongue). The olfactory modulators are administered in any suitable manner, optionally with acceptable carriers. Suitable methods of administering such modulators are available and well known to those of skill in the art, and, although more than one route can be used to administer a particular composition, a particular route can often provide a more immediate and more effective reaction than another route. Acceptable carriers are determined at least in part by the particular components of the composition to be administered (e.g., stabilizing the sensants), as well as by the particular method used to administer the composition. Accordingly, there is a wide variety of suitable formulations of pharmaceutical compositions of the present invention (see, e.g., *Remington's Pharmaceutical Sciences,* 17th ed. 1985).

The sensory modulators, alone or in combination with other suitable components, can be made into aerosol formulations (i.e., they can be "nebulized") to be administered via inhalation. Aerosol formulations can be placed into pressurized acceptable propellants, such as dichloro-difluoromethane, propane, nitrogen, and the like that may or may not contribute to sensory perception. Other possible formulation include dry or liquid forms, powders or tablets, solutions of polar (e.g., water) or nonpolar (e.g., alcohol) solvents, emulsions or suspensions, creams, gels, lotions, and syrups.

Formulations suitable for administration include aqueous and non-aqueous solutions, isotonic sterile solutions, which can contain antioxidants; buffers, bacteriostats, and solutes that render the formulation isotonic, and aqueous and non-aqueous sterile suspensions that can include suspending agents, solubilizers, thickening agents, stabilizers, and preservatives. In the practice of this invention, compositions can be administered, for example, by orally, topically, intravenously, intraperitoneally, intravesically, or intrathecally. Optionally, the compositions are administered orally or nasally. The formulations of compounds can be presented in unit-dose or multi-dose sealed containers, such as ampules and vials. Solutions and suspensions can be prepared from sterile powders, granules, and tablets of the kind previously described. The modu-lators can also be administered as part a of prepared drug, food, or cosmetic. In particular, an un-pleasant odor or taste (e.g., sulfur or bitter, respectively) may not be perceived as such and/or its effects reduced by blocking the binding between sensant ligand and sensory receptor by adding a competitor ligand that blocks binding between cognate ligand and receptor, or inhibiting or reducing signal transduction. In contrast, a pleasant odor or taste can be mimicked or enhanced. Primary sensants are preferred because the subset of activated cells is kept small and the effects limited to projection into a specific region of the brain. But novel olfactants or combinations thereof that bind only a few olfactory receptors (e.g., having less than five different ligand-binding domains) would also be useful.

The dose administered to a mammal (e.g., human) should be sufficient to effect a beneficial response in the subject over time. The dose will be determined by the efficacy of the parti-cular sensory modulators employed and the condition of the subject, as well as the body weight or surface area of the area to be treated. The size of the dose also will be determined by the existence, nature, and extent of any adverse side-effects that accompany the administration of a particular compound or vector in a particular subject. In determining the effective amount of the modulator to be administered in a physician may evaluate circulating plasma levels of the sensory modulator, modulator toxicities,, and the production of anti-modulator antibodies. In general, the dose equivalent of a modulator is from about 1 ng/kg to 10 mg/kg for the typical mammal. For administration, sensory modulators can be administered at a rate determined by the $ED_{50}$ of the modulator, and the side-effects of the inhibitor at various concentrations, as applied to the mass and overall health of the mammal. Administration can be accomplished via single or divided doses.

I. Kits

Sensory receptor genes, or fragments or variants thereof are useful tools for identifying cells expressing sensory receptors, for forensics and paternity determinations, and for examining signal transduction in isolated cells. Sensory receptor family member-specific reagents that specifically hybridize to sensory receptor nucleic acids, such AOFLF1 probes and primers, and sensory receptor specific reagents that specifically bind to a sensory receptor protein, e.g., anti-sensory receptor antibodies are used to examine expression in cells and regulation of signal trans-duction. For example, one or more family member-specific reagents may be used to detect poly-morphisms that are linked to genetic anosmia or to detect allelic exclusion.

Nucleic acid assays for the presence of DNA and RNA for a sensory receptor family member in a sample include numerous techniques are known to those skilled in the art, such as Southern analysis, Northern analysis, dot blots, RNase protection, S1 analysis, amplification techniques such as PCR, and in situ hybridization. In in situ hybridization, for example, the target nucleic acid is liberated from its cellular surroundings in such as to be available for hybridization within the cell while preserving the cellular morphology for subsequent interpretation and analysis. The following articles provide an overview of the art of in situ hybridization: Singer et al., *Biotechniques,* 4:230-250 (1986); Haase et al., *Methods in Virology,* vol. VII, pp. 189-226 (1984); and *Nucleic Acid Hybridization: A Practical Approach* (Names et al., eds. 1987). In addition, a sensory receptor protein can be detected with the various immunoassay techniques described above. The test sample is typically compared to both a positive control (e.g., a sample expressing a recombinant sensory receptor protein) and a negative control.

The present invention also provides for kits for screening for novel modulators of sensory receptor family members. Such kits can be prepared from readily available materials and reagents, as well as any of the aforementioned products. For example, such kits can comprise any one or more of the following materials: sensory receptor nucleic acids or proteins, reaction tubes, and instructions for testing sensory receptor activity. Optionally, the kit contains a biologically active sensory receptor. A wide variety of kits and components can be prepared according to the present invention, depending upon the intended user of the kit and the particular needs of the user.

SEQUENCE LISTING (522 sequences)

SEQ ID NO: 1 - protein, 325 aa, Homo sapiens
MKTFSSFLQIGRNMHQGNQTTITEFILLGFFKQDEHQNLLFVLFLGMYLVTVIGNGLIIVAISLDTYLHTPMYLFLANLSFADISSISNSVPKMLVNIQTKSQSISYESCITQMYFSIVFVVIDNLLLGTMAYDHFVAICHPLNYTILMRPRFGILLTVISWFLSNIIALTHTLLLIQLLFCNHNTLPHFFCDLAPLLKLSCSDTLINELVLFIVGLSVIIFPFTLSFFSYVCIIRAVLRVSSTQGKWKAFSTCGSHLTVVLLFYGTIVGVYFFPSSTHPEDTDKIGAVLFTVVTPMINPFIYSLRNKDMKGALRKLINRKISSL

SEQ ID NO: 2 - DNA, 978 bp, Homo sapiens
atgaagacttttagttcctttcttcagatcggcagaaatatgcatcaaggaaaccaaaccaccatcactgaattcattctcctgggatttttcaagcaggatgagcatcaaaacctcctctttgtgcttttcttgggtatgtacctggtcactgtgattgggaacgggctcatcattgtggctatcagcttggatacgtaccttcatacccccatgtatctcttccttgccaatctatcctttgctgatatttcctccatttccaactcagtccccaaaatgctggtgaatattcaaaccaagagtcaatccatctcttatgagagctgcatcacacagatgtacttttctattgtgtttgtcgtcattgacaatttgctcttggggaccatggcctatgaccactttgtggcgatctgccaccctctgaattatacaattctcatgcggcccaggttcggcattttgctcacagtcatctcatggttcctcagtaatattattgctctgacacacacccttctgctcattcaattgctcttctgtaaccacaacactctcccacacttcttctgtgacttggcccctctgctcaaactgtcctgttcagatacattgatcaatgagcttgtgttgtttattgtgggtttatcagttatcatcttcccctttacactcagcttcttttcctatgtctgcatcatcagagctgtcctgagagtatcttccacacagggaaagtggaaagccttctccacttgtggctctcacctgacagttgtattactgttctacggaaccattgtaggcgtgtactttttcccctcctccactcaccctgaggacactgataagattggtgctgtcctattcactgtggtgacacccatgataaaccccttcatctacagcttgaggaataaggatatgaaaggtgccctgagaaagctcatcaatagaaaaatttcttccctttga

SEQ ID NO: 3 - protein, 314 aa, Homo sapiens
MMMVLRNLSMEPTFALLGFTDYPKLQIPLFLVFLLMYVITVVGNLGMIIIIKINPKFHTPMYFFLSHLSFVDFCYSSIVTPKLLENLVMADKSIFYFSCMMQYFLSCTAVVTESFLLAVMAYDRFVAICNPLLYTVAMSQRLCALLVAGSYLWGMFGPLVLLCYALRLNFSGPNVINHFFCEYTALISVSGSDILIPHLLLFSFATFNEMCTLLIILTSYVFIFVTVLKIRSVSGRHKAFSTWASHLTAITIFHGTILFLYCVPNSKNSRQTVKVASVFYTVVNPMLNPPIYSLRNKDVKDAFWKLIHTQVPFH

SEQ ID NO: 4 - DNA, 945 bp, Homo sapiens
atgatgatggttttaaggaatctgagcatggagcccacctttgcccttttaggtttcacagattacccaaagcttcagattcctctcttccttgtgtttctgctcatgtatgttatcacagtggtaggaaaccttgggatgatcataataatcaagattaaccccaaatttcacactcctatgtactttttccttagtcacctctcttttgttgatttttgttactcttccattgtcactcccaagctgcttgagaacttggtaatggcagataaaagcatcttctactttagctgcatgatgcagtacttcctgtcctgcactgctgtggtgacagagtctttcttgctggcagtgatggcctatgaccgctttgtggccatctgcaatcctctgctttatacagtggccatgtcacagaggctctgtgccctgctggtggctgggtcatatctctggggcatgtttggccccttggtactcctttgttatgctctccggttaaacttctctggacctaatgtaatcaaccacttcttttgtgagtatactgctctcatctctgtgtctggctctgatatactcatcccccacctgctgcttttcagcttcgccaccttcaatgagatgtgtacactactgatcatcctcacttcctatgttttcatttttgtgactgtactaaaaatccgttctgttagtgggcgccacaaagccttctccacctgggcctcccacctgactgctatcaccatcttccatgggaccatccttttcctttactgtgtacccaactccaaaaactctcggcaaacagtcaaagtggcctctgtattttacacagttgtcaaccccatgctgaaccctccgatctacagcctaaggaataaagacgtgaaggatgctttctggaagttaatacatacacaagttccatttcactga

SEQ ID NO: 5 - protein, 313 aa, Homo sapiens
MLLTDRNTSGTTFTLLGFSDYPELQVPLFLVFLAIYNVTVLGNIGLIVIIKINPKLHTPMYFFLSQLSFVDFCYSSIIAPKMLVNLVVKDRTISFLGCVVQFFFFCTFVVTESFLLAVMAYDRFVAICNPLLYTVDMSQKLCVLLVVGSYAWGVSCSLELTCSALKLCFHGFNTINHFFCEFSSLLSLSCSDTYINQWLLFFLATFNEISTLLIVLTSYAFIVVTILKMRSVSGRRKAFSTCASHLTAITIFHGTILFLYCVPNSKNSRHTVKVASVFYTVVIPMLNPLIYSLRNKDVKDTVTEILDTKVFSY

SEQ ID NO: 6 - DNA, 942 bp, Homo sapiens
atgctgctgacagatagaaatacaagtgggaccacgttcaccctcttgggcttctcagattacccagaactgcaagtcccactcttcctggtttttctggccatctacaatgtcactgtgctagggaatattgggttgattgtgatcatcaaaatcaaccccaaactgcatacccccatgtactttttcctcagccaactctcctttgtggatttctgctattcctccatcattgctcccaagatgttggtgaaccttgttgtcaaagacagaaccatttcatttttaggatgcgtagtacaattctttttcttctgtacctttgtggtcactgaatcctttttattagctgtgatggcctatgaccgcttcgtggccatttgcaaccctctgctctacacagttgacatgtcccagaaactctgcgtgctgctggttgtgggatcctatgcctggggagtctcatgttccttggaactgacgtgctctgctttaaagttatgttttcatggtttcaacacaatcaatcacttcttctgtgagttctcctcactactctccctttcttgctctgatacttacatcaaccagtggctgctattctttcttgccacctttaatgaaatcagcacactactcatcgttctcacatcttatgcgttcattgttgtaaccatcctcaagatgcgttcagtcagtgggcgccgcaaagccttctccacctgtgcctcccacctgactgccatcaccatcttccatggcaccatcctcttcctttactgtgtgcccaactccaaaaactccaggcacacagtcaaagtggcctctgtgttttacaccgtggtgatccccatgttgaatcccctgatctacagtctgagaaataaagatgtcaaggatacagtcaccgagatactggacaccaaagtcttctcttactga

SEQ ID NO: 7 - protein, 309 aa, Homo sapiens
MENQNNVTEFILLGLTENLELWKIFSAVFLVMYVATVLENLLIVVTIITSQSLRSPMYFFLTFLSLLDVMFSSVVAPKVIVDTLSKSTTISLKGCLTQLFVEHFFGGVGIILLTVMAYDRYVAICKPLHYTIIMSPRVCCLMVGGAWVGGFMHAMIQLLFMYQIPFCGPNIIDHFICDLFQLLTLACTDTHILGLLVTLNSGMMCVAIFLILIASYTVILCSLKSYSSKGRHKALSTCSSHLTVVVLFFVPCIFLYMRPVVTHPIDKAMAVSDSIITPMLNPLIYTLRNAEVKSAMKKLWMKWEALAGK

SEQ ID NO: 8 - DNA, 930 bp, Homo sapiens
atggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataa

SEQ ID NO: 9 - protein, 311 aa, Homo sapiens
MGKENCTTVAEFILLGLSDVPELRVCLFLLFLLIYGVTLLANLGMIALIQVSSRLHTPMYFFLSHLSSVDFCYSSIIVPKMLANIFNKDKAISFLGCMVQFYLFCTCVVTEVFLLAVMAYDRFVAICNPLLYTVTMSWKVRVELASCCYFCGTVCSLIHLCLALRIPFYRSNVINHFFCDLPPVLSLACSDITVNETLLFLVATLNESVTIMIILTSYLLILTTILKMGSAEGRHKAFSTCASHLTAITVFHGTVLSIYCRPSSGNSGDADKVATVFYTVVIPMLNSVIYSLRNKDVKEALRKVMGSKIHS

SEQ ID NO: 10 - DNA, 936 bp, Homo sapiens
atgggcaaggaaaactgcaccactgtggctgagttcattctccttggactatcagatgtccctgagttgagagtctgcctcttcctgctgttccttctcatctatggagtcacgttgttagccaacctgggcatgattgcactgattcaggtcagctctcggctccacacccccatgtactttttcctcagccacttgtcctctgtagatttctgctactcctcaataattgtgccaaaaatgttggctaatatctttaacaaggacaaagccatctccttcctagggtgcatggtgcaattctacttgttttgcacttgtgtggtcactgaggtcttcctgctggccgtgatggcctatgaccgctttgtggccatctgtaaccctttgctatacacagtcaccatgtcttggaaggtgcgtgtggagctggcttcttgctgctacttctgtgggacggtgtgttctctgattcatttgtgcttagctcttaggatccccttctatagatctaatgtgattaaccactttttctgtgatctacctcctgtcttaagtcttgcttgctctgatatcactgtgaatgagacactgctgttcctggtggccactttgaatgagagtgttaccatcatgatcatcctcacctcctacctgctaattctcaccaccatcctgaagatgggctctgcagagggcaggcacaaagccttctccacctgtgcttcccacctcacagctatcactgtcttccatggaacagtcctttccatttattgcaggcccagttcaggcaatagtggagatgctgacaaagtggccaccgtgttctacacagtcgtgattcctatgctgaactctgtgatctacagcctgagaaataaagatgtgaaagaagctctcagaaaagtgatgggctccaaaattcactcctag

SEQ ID NO: 11 - protein, 314 aa, Homo sapiens [sequence omitted]

SEQ ID NO: 12 - DNA, 945 bp, Homo sapiens
atgatggcatctgaaagaaatcaaagcagcacacccacttttattctcttgggtttttcagaatacccagaaatccaggttccactctttctggttttcttgttcgtctacacagtcactgtagtggggaacttgggcatgataataatcatcagactcaattcaaaactccatacaatcatgtactttttccttagtcacttgtccttgacagacttctgtttttccactgtagttacacctaaactgttggagaacttggttgtggaatacagaaccatctctttctctggttgcatcatgcaattttgttttgcttgcatttttggagtgacagaaactttcatgttagcagcgatggcttatgaccgttttgtggcagtttgtaaacccttgctgtataccactattatgtctcagaagctctgtgctcttctggtggctgggtcctatacatgggggatagtgtgctccctgatactcacatattttcttcttgacttatcgttttgtgaatctaccttcataaataattttatctgtgaccactctgtaattgtttctgcctcctactcagacccctatatcagccagaggctatgctttattattgccatattcaatgaggtgagcagcctaattatcattctgacatcatatatgcttattttcactaccattatgaagatgcgatctgcaagtgggcgccagaaaactttctccacctgtgcctcccacctgacagccatcactatcttccatggaactatccttttcctttactgtgttcctaatcctaaaacttctagcctcatagttacagtggcttctgtgttttacacagtggcgattccaatgctgaacccattgatctacagccttaggaacaaagatatcaataacatgtttgaaaaattagttgtcaccaaattgatttaccactga

SEQ ID NO: 13 - protein, 347 aa, Homo sapiens
MSYFYRLKLMKEAVLVKLPFTSLPLLLQTLSRKSRDMEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYR

SEQ ID NO: 14 - DNA, 1044 bp, Homo sapiens
atgagctatttttacaggcttaagcttatgaaagaagctgtcttggtcaaactgccctttacatctctcccactgcttctccaaaccctatccaggaagtccagagacatggagataaagaactacagcagcagcacctcaggcttcatcctcctgggcctctcttccaaccctcagctgcagaaacctctctttgccatcttcctcatcatgtacctgctcgctgcggtggggaatgtgctcatcatcccggccatctactctgaccccaggctccacacccctatgtacttttttctcagcaacttgtctttcatggatatctgcttcacaacagtcatagtgcctaagatgctggtgaattttctatcagagacaaaggttatctcctatgtgggctgcctggcccagatgtacttctttatggcatttgggaacactgacagctacctgctggcctctatggccatcgaccggctggtggccatctgcaaccccttacactatgatgtggttatgaaaccacggcattgcctgctcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtatcatcttctcctacctgcgaatcatggtcactgtgctcagaatcccctctgcagccgggaagtggaaggccttctctacctgtggctcccacctcactgcagtagcccttttctatgggagtattatttatgtctattttaggcccctgtccatgtactcagtggttagggaccgggtagccacagttatgtacacagtagtgacacccatgctgaaccctttcatctacagcctgaggaacaaagatatgaagaggggtttgaagaaattacaggacagaatttaccggtaa

SEQ ID NO: 15 - protein, 311 aa, Homo sapiens
MATSNHSSGAEFILAGLTQRPELQLPLFLLFLGIYVVTVVGNLGMIFLIALSSQLYPPVYYFLSHLSFIDLCYSSVITPKMLVNFVPEENIISFLECITQLYFFLIFVIAEGYLLTAMEYDRYVAICRPLLYNIVMSHRVCSIMMAVVYSLGFLWATVHTTRMSVLSFCRSHTVSHYFCDILPLLTLSCSSTHINEILLFIIGGVNTLATTLAVLISYAFIFSSILGIHSTEGQSKAFGTCSSHLLAVGIFFGSITFMYFKPPSSTTMEKEKVSSVFYITIIPMLNPLIYSLRNKDVKNALKKMTRGRQSS

SEQ ID NO: 16 - DNA, 936 bp, Homo sapiens
atggctacttcaaaccattcttcaggggctgagtttatcctggcaggcttgacacaacgcccagaacttcaactgccactcttcctcctgttccttggaatatatgtggtcacagtggtggggaacctgggcatgatcttcttaattgctctcagttctcaactttaccctccagtgtattattttctcagtcatttgtctttcattgatctctgctactcctctgtcattacccctaagatgctggtgaactttgttccagaggagaacattatctcctttctggaatgcattactcaactttatttcttccttatttttgtaattgcagaaggctaccttctgacagccatggaatatgaccgttatgttgctatctgtcgcccactgctttacaatattgtcatgtcccacagggtctgttccataatgatggctgtggtatactcactgggttttctgtgggccacagtccatactacccgcatgtcagtgttgtcattctgtaggtctcatacggtcagtcattatttttgtgatattctccccttattgactctgtcttgctccagcacccacatcaatgagattctgctgttcattattggaggagttaataccttagcaactacactggcggtccttatctcttatgctttcattttctctagtatccttggtattcattccactgaggggcaatccaaagcctttggcacttgtagctcccatctcttggctgtgggcatcttttttgggtctataacattcatgtatttcaagcccccttccagcactactatggaaaaagagaaggtgtcttctgtgttctacatcacaataatccccatgctgaatcctctaatctatagcctgaggaacaaggatgtgaaaaatgcactgaagaagatgactaggggaaggcagtcatcctga

SEQ ID NO: 17 - protein, 313 aa, Homo sapiens [sequence omitted]

SEQ ID NO: 18 - DNA, 942 bp, Homo sapiens
atgctggctagaaacaactccttagtgactgaatttattcttgctggattaacagatcgtccagagttctggcaacccttctttttcctgttcctagtgatctacattgtcaccatggtaggcaaccttggcttgatcactcttttcggtctaaattctcacctccacacaccaatgtactatttcctcttcaatctctccttcattgatctctgttactcctctgttttcactcccaaaatgctaatgaactttgtgtcaaaaaagaatattatctccaatgttgggtgcatgactcggctgtttttctttctctttttcgtcatctctgaatgttacatgttgacctcaatggcatatgatcgctatgtggccatctgtaatccattgctgtataaggtcaccatgtcccatcaggtctgttctatgctcacttttgctgcttacataatgggattggctggagccacggcccacaccgggtgcatgtttagactcaccttctgcagtgctaatatcattaaccattacttgtgtgacatactccccctcctccagctttcctgcaccagcacctatgtcaacgaggtggttgttctcattgttgtgggtactaatatcacggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagttttttctgttttctacactaatgtggtgcccatgctcaatcccctcatctacagtttgaggaacaaggatgtcaaagttgcactgaggaaagctctgattaaaattcagaggagaaatatattctaa

SEQ ID NO: 19 - protein, 313 aa, Homo sapiens [sequence omitted]

SEQ ID NO: 20 - DNA, 942 bp, Homo sapiens
atgctggctagaaacaactccttagtgactgaatttattcttgctggattaacagatcgtccagagttccggcaacccctctttttcctgtttctagtgatctacattgtcaccatggtaggcaaccttggcttgatcattcttttcggtctaaattctcacctccacacaccaatgtactatttcctcttcaatctctccttcattgatctctgttactcctctgttttcactcccaaaatgctaatgaactttgtatcaaaaaagaatattatctcctatgttgggtgcatgactcagctgtttttctttctcttttttgtcatctctgaatgctacatattgacctcaatggcatatgatcgctatgtggccatctgtaatccattgctgtataaggtcaccatgtcccatcaggtctgttctatgctcacttttgctgcttacataatgggattggctggagccacggcccacaccgggtgcatgcttagactcaccttctgcagtgctaatatcatcaaccattacttgtgtgacatactccccctcctccagctttcctgcaccagcacctatgtcaacgaggtggttgttctcattgttgtgggtattaatatcatggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagtttcttctgttttctacactaatgtggtgcccatgctcaatcctctcatctacagtttgaggaacaaggatgtcaaagttgcactgaggaaagctctgattaaaattcagagaagaaatatattctaa

SEQ ID NO: 21 - protein, 309 aa, Homo sapiens
MTLRNSSSVTEFILVGLSEQPELQLPLFLLFLGIYVFTVVGNLGLITLIGINPSLHTPMYFFLFNLSFIDLCYSCVFTPKMLNDFVSESIISYVGCMTQLFFFCFFVNSECYVLVSMAYDRYVAICNPLLYMVTMSPRVCFLLMFGSYVVGFAGAMAHTGSMLRLTFCDSNVIDHYLCDVLPLLQLSCTSTHVSELVFFIVVGVITMLSSISIVISYALILSNILCIPSAEGRSKAFSTWGSHIIAVALFFGSGTFTYLTTSFPGSMNHGRFASVFYTNVVPMLNPSIYSLRNKDDKLALGKTLKRVLF

SEQ ID NO: 22 - DNA, 930 bp, Homo sapiens
atgactctgagaaacagctcctcagtgactgagtttatccttgtgggattatcagaacagccagagctccagctccctcttttccttctattcttagggatctatgtgttcactgtggtgggcaacttgggcttgatcaccttaattgggataaatcctagccttcacacccccatgtactttttcctcttcaacttgtcctttatagatctctgttattcctgtgtgtttacccccaaaatgctgaatgactttgtttcagaaagtatcatctcttatgtgggatgtatgactcagctatttttcttctgtttctttgtcaattctgagtgctatgtgttggtatcaatggcctatgatcgctatgtggccatctgcaaccccctgctctacatggtcaccatgtccccaagggtctgctttctgctgatgtttggttcctatgtggtagggtttgctggggccatggcccacactggaagcatgctgcgactgaccttctgtgattccaacgtcattgaccattatctgtgtgacgttctccccctcttgcagctctcctgcaccagcacccatgtcagtgagctggtatttttcattgttgttggagtaatcaccatgctatccagcataagcatcgtcatctcttacgctttgatactctccaacatcctctgtattccttctgcagagggcagatccaaagcctttagcacatggggctcccacataattgctgttgctctgttttttgggtcagggacattcacctacttaacaacatcttttcctggctctatgaaccatggcagatttgcctcagtcttttacaccaatgtggttcccatgcttaacccttcgatctacagtttgaggaataaggatgataaacttgccctgggcaaaaccctgaagagagtgctcttctaa

SEQ ID NO: 23 - protein, 360 aa, Homo sapiens
MERNHNPDNCNVLNFFFADKKNKRRNFGQIVSDVGRICYSVSLSLGEPTTMGRNNLTRPSEFILLGLSSRPEDQKPLFAVFLPIYLITVIGNLLIILAIRSDTRLQTPMYFFLSILSFVDICYVTVIIPKMLVNFLSETKTISYGECLTQMYFFLAFGNTDSYLLAAMAIDRYVAICNPFHYITIMSHRCCVLLLVLSFCIPHFHSLLHILLTNQLIFCASNVIHHFFCDDQPVLKLSCSSHFVKEITVMTEGLAVIMTPFSCIIISYLRILITVLKIPSAAGKRKAFSTCGSHLTVVTLFYGSISYVYFQPLSNYTVKDQIATIIYTVLTPMLNPFIYSLRNKDMKQGLAKLMHRMKCQ

SEQ ID NO: 24 - DNA, 1083 bp, Homo sapiens
atggaaagaaaccacaatccagataattgtaatgttttaaattttttctttgctgataagaagaataaaaggagaaattttggacagattgtatcagatgttggaagaatctgttacagtgttagtttatctttaggtgaacccacaactatgggaagaaataacctaacaagaccctctgaattcatcctccttggactctcctctcgacctgaggatcagaagccgctctttgctgtgttcctccccatctaccttatcacagtgataggaaacctgcttatcatcctggccatccgctcagacactcgtctccagacgcccatgtacttctttctaagcatcctgtcttttgttgacatttgctatgtgacagtcattatccctaagatgctggtgaacttcttatcagagacaaagaccatctcttacggtgagtgtctgacccagatgtactttttcttagcctttggaaacacagacagttacctgctagcagccatggccattgaccgctatgtggccatatgtaatcccttccactacatcaccattatgagtcacagatgctgtgtcctgcttctggttctctccttctgcattccacattttcactccctcctgcacattcttctgactaatcagctcatcttctgtgcctccaatgtcatccatcactttttctgcgatgatcaaccagtgctaaaattgtcctgttcctcccattttgtcaaagaaatcacagtaatgacagaaggcttggctgtcataatgaccccgttttcatgcatcatcatctcttatttaagaatcctcatcactgttctgaagattccttcagctgctggaaagcgtaaagcattttctacctgtggctctcatctcacagtggtgaccctgttttatggaagcattagctatgtctattttcagcccctgtccaactatactgtcaaggatcaaatagcaacaattatctacaccgtactgactcctatgctaaatccatttatctatagtctgaggaacaaagacatgaagcagggtttggcaaagttgatgcacaggatgaaatgtcagtaa

SEQ ID NO: 25 - protein, 312 aa, Homo sapiens
  MOD_RES (273): Variable amino acid
MDQKNGSSFTGFILLGFSDRPQLELVLFVVLLIFYIFTLLGNKTIIVLSHLDPHLHNPMYFFFSNLSFLDLCYTTGIVPQLLVNLRGADKSISYGGCVVQLYISLGLGSTECVLLGVMAFDRYAAVCRPLHYTVVMHPCLYVLMASTSWVIGFANSLLQTVLILLLTLCGRNKLEHFLCEVPPLLKLACVDTTMNESELFFVSVIILLVPVALIIFSYSQIVRAVVRIKSATGQRKVFGTCGSHLTVVSLFYGTAIYAYLQPGNNYSQDQGKXISLFYTIITPMINPLIYTLRNKDVKGALKKVLWKNYDSR

SEQ ID NO: 26 - DNA, 939 bp, Homo sapiens
atggatcagaaaaatggaagttctttcactggatttatcctactgggtttctctgacaggcctcagctggagctagtcctctttgtggttcttttgatcttctatatcttcactttgctggggaacaaaaccatcattgtattatctcacttggacccacatcttcacaatcctatgtattttttcttctccaacctaagctttttggatctgtgttacacaaccggcattgttccacagctcctggttaatctcaggggagcagacaaatcaatctcctatggtggttgtgtagttcagctgtacatctctctaggcttgggatctacagaatgcgttctcttaggagtgatggcatttgaccgctatgcagctgtttgcaggcccctccactacacagtagtcatgcacccttgtctgtatgtgctgatggcttctacttcatgggtcattggttttgccaactccctattgcagacggtgctcatcttgcttttaacactttgtggaagaaataaattagaacactttctttgtgaggttcctccattgctcaagcttgcctgtgttgacactactatgaatgaatctgaactcttctttgtcagtgtcattattcttcttgtacctgttgcattaatcatattctcctatagtcagattgtcagggcagtcgtgaggataaagtcagcaacagggcagagaaaagtgtttgggacatgtggctcccacctcacagtggtttccctgttctacggcacagctatctatgcttacctccagcccggcaacaactactctcaggatcagggcaagktcatctctctcttctacaccatcattacacccatgatcaaccccctcatatatacactgaggaacaaggatgtgaaaggagcacttaagaaggtgctctggaagaactacgactccagatga

SEQ ID NO: 27 - protein, 341 aa, Homo sapiens
MALPLLLSPSCFASSQSLSSRMNSENLTRAAVAPAEFVLLGITNRWDLRVALFLTCLPVYLVSLLGNMGMALLIRMDARLHTPMYFFLANLSLLDACYSSAIGPKMLVDLLLPRATIPYTACALQMFVFAGLADTECCLLAAMAYDRYVAIRNPLLYTTAMSQRLCLALLGASGLGGAVSAFVHTTLTFRLSFCRSRKINSFFCDIPPLLAISCSDTSLNELLLFAICGFIQTATVLAITVSYGFIAGAVIHMRSVEGSRRAASTGGSHLTAVAMMYGTLIFMYLRPSSSYALDTDKMASVFYTLVIPSLNPLIYSLRNKEVKEALRQTWSRFHCPGQGSQ

SEQ ID NO: 28 - DNA, 1026 bp, Homo sapiens
atggccttgccattgctcttatctccctcctgctttgcctcttctcagtctctgtccagtaggatgaactcagagaacctcacccgggccgcggttgcccctgctgaattcgtcctcctgggcatcacaaatcgctgggacctgcgtgtggccctcttcctgacctgcctgcctgtctacctggtgagcctgctgggaaacatgggcatggcgctgctgatccgcatggatgcccggctccacacacctatgtacttcttcctggccaacctctccctgctggatgcctgctattcctccgccatcggccccaagatgctagtggacctgctgctgccccgagccaccatcccttacacagcctgtgccctccagatgtttgtctttgcaggtctggctgatactgagtgttgcttgctggcagccatggcctatgaccgctacgtggccatcagaaacccacttctctatacaacagctatgtcgcagcgtctatgcctggccttgctgggagcatcaggcctgggtggggcagtgagtgcctttgttcacacaaccctcaccttccgcctgagcttctgccgctcccggaagatcaatagcttcttctgcgatatccctccactgctggccatctcgtgcagtgacaccagtctcaatgaactccttctcttcgccatctgtggcttcatccagacagccacggtgttagctatcacggtgtcttatggcttcatcgctggggctgtgatccacatgcgctcggtcgagggcagtcggcgagcagcctccaccggtggttcccacctcacagccgtggccatgatgtacgggacactcattttcatgtacctgcgccccagctccagctatgccctggacactgacaagatggcctctgtgttctataccctggtcatcccgtctctcaacccactcatctacagcctccgcaataaggaggtcaaggaggccctcaggcagacctggagccgattccactgtccagggcaggggtcccagtga

SEQ ID NO: 29 - protein, 309 aa, Homo sapiens
MRENNQSSTLEFILLGVTGQQEQEDFFYILFLFIYPITLIGNLLIVLAICSDVRLHNPMYFLLANLSLVDIFFSSVTIPKMLANHLLGSKSISFGGCLTQMYFMIALGNTDSYILAAMAYDRAVAISHPLHYTTIMSPRSCIWLIAGSWVIGNANALPHTLLTASLSFCGNQEVANFYCDITPLLKLSCSDIHFHVKMMYLGVGIFSVPLLCIIVSYIRVFSTVFQVPSTKGVLKAFSTCGSHLTVVSLYYGTVMGTYFRPLTNYSLKDAVITVMYTAVTPMLNPFIYSLRNRDMKAALRKLFNKRISS

SEQ ID NO: 30 - DNA, 930 bp, Homo sapiens
atgagggaaaataaccagtcctctacactggaattcatcctcctgggagttactggtcagcaggaacaggaagatttcttctacatcctcttcctgttcatttaccccatcacattgattggaaacctgctcattgtcctagccatttgctctgatgttcgccttcacaaccccatgtattttctccttgccaacctctccttggttgacatcttcttctcatcggtaaccatccctaagatgctggccaaccatctcttgggcagcaaatccatctcttttgggggatgcctaacgcagatgtatttcatgatagccttgggtaacacagacagctatattttggctgcaatggcatatgatcgagctgtggccatcagccacccacttcactacacaacaattatgagtccacggtcttgtatctggcttattgctgggtcttgggtgattggaaatgccaatgccctcccccacactctgctcacagctagtctgtccttctgtggcaaccaggaagtggccaacttctactgtgacattacccccttgctgaagttatcctgttctgacatccactttcatgtgaagatgatgtacctaggggttggcattttctctgtgccattactatgcatcattgtctcctatattcgagtcttctccacagtcttccaggttccttccaccaagggcgtgctcaaggccttctccacctgtggttcccacctcacggttgtctctttgtattatggtacagtcatgggcacgtatttccgccctttgaccaattatagcctaaaagacgcagtgatcactgtaatgtacacggcagtgaccccaatgttaaatcctttcatctacagtctgagaaatcgggacatgaaggctgccctgcggaaactcttcaacaagagaatctcctcgtaa

SEQ ID NO: 31 - protein, 311 aa, Homo sapiens
MRRNCTLVTEFILLGLTSRRELQILLFTLFLAIYMVTVAGNLGMIVLIQANAWLHMPMYFFLSHLSFVDLCFSSNVTPKMLEIFLSEKKSISYPACLVQCYLFIALVHVEIYILAVMAFDRYMAICNPLLYGSRMSKSVCSFLITVPYVYGALTGLMETMWTYNLAFCGPNEINHFYCADPPLIKLACSDTYNKELSMFIVAGWNLSFSLFIICISYLYIFPAILKIRSTEGRQKAFSTCGSHLTAVTIFYATLFFMYLRPPSKESVEQGKMVAVFYTTVIPMLNLIIYSLRNKNVKEALIKELSMKIYFS

SEQ ID NO: 32 - DNA, 936 bp, Homo sapiens
atgagaagaaactgcacgttggtgactgagttcattctcctgggactgaccagtcgccgggaattacaaattctcctcttcacgctgtttctggccatttacatggtcacggtggcagggaaccttggcatgattgtcctcatccaggccaacgcctggctccacatgcccatgtactttttcctgagccacttatccttcgtggatctgtgcttctcttccaatgtgactccaaagatgctggagattttcctttcagagaagaaaagcatttcctatcctgcctgtcttgtgcagtgttacctttttatcgccttggtccatgttgagatctacatcctggctgtgatggcctttgaccggtacatggccatctgcaaccctctgctttatggcagcagaatgtccaagagtgtgtgctccttcctcatcacggtgccttatgtgtatggagcgctcactggcctgatggagaccatgtggacctacaacctagccttctgtggccccaatgaaattaatcacttctactgtgcggacccaccactgattaagctggcttgttctgacacctacaacaaggagttgtcaatgtttattgtggctggctggaacctttctttttctctcttcatcatatgtatttcctacctttacattttccctgctattttaaagattcgctctacagagggcaggcaaaaagctttttctacctgtggctcccatctgacagctgtcactatattctatgcaacccttttcttcatgtatctcagacccccctcaaaggaatctgttgaacagggtaaaatggtagctgtattttataccacagtaatccctatgctgaaccttataatttatagccttagaaataaaaatgtaaaagaagcattaatcaaagagctgtcaatgaagatatacttttcttaa

SEQ ID NO: 33 - protein, 307 aa, Homo sapiens
MLNFTDVTEFILLGLTSRREWQVLFFIIFLVVYIITMVGNIGMMVLIKVSPQLNNPMYFFLSHLSFVDVWFSSNVTPKMLENLFSDKKTITYAGCLVQCFFFIALVHVEIFILAAMAFDRYMAIGNPLLYGSKMSRVVCIRLITFPYIYGFLTSLAATLWTYGLYFCGKIEINHFYCADPPLIKMACAGTFVKEYTMIILAGINFTYSLTVIIISYLFILIAILRMRSAEGRQKAFSTCGSHLTAVIIFYGTLIFMYLRRPTEESVEQGKMVAVFYTTVIPMLNPMIYSLRNKDVKKAMMKVISRSC

SEQ ID NO: 34 - DNA, 924 bp, Homo sapiens
atgctcaatttcaccgatgtgacagagttcattcttttggggctaacgagccgtcgagaatggcaagttctcttcttcatcatctttcttgtggtctacatcatcaccatggtgggcaatatcggcatgatggtgttaatcaaggtcagtcctcagcttaacaaccccatgtactttttcctcagtcacttgtcatttgttgatgtgtggttttcttccaatgtcacccctaaaatgttggaaaacctgttttcagataaaaaaacaattacttatgctggttgtttagtacagtgtttcttcttcattgctcttgtccatgtggaaatttttattcttgctgcgatggcctttgatagatacatggcaattgggaatcctctgctttatggcagtaaaatgtcaagggttgtctgtattcgactgattactttcccttacatttatggttttctgacgagtctggcagcaacattatggacttacggcttgtacttctgtggaaaaattgagatcaaccatttctactgtgcagatccacctctcatcaaaatggcctgtgccgggacctttgtaaaagaatatacaatgatcatacttgccggcattaacttcacatattccctgactgtaattatcatctcttacttattcatcctcattgccattctgcgaatgcgctcagcagaaggaaggcagaaggccttttccacatgtgggtcccatctgacagctgtcattatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaa

SEQ ID NO: 35 - protein, 305 aa, Homo sapiens [sequence omitted]

SEQ ID NO: 36 - DNA, 918 bp, Homo sapiens
atgtccaacacaaatggcagtgcaatcacagaattcattttacttgggctcacagattgcccggaactccagtctctgctttttgtgctgtttctggttgtttacctcgtcaccctgctaggcaacctgggcatgataatgttaatgagactggactctcgccttcacacgcccatgtacttcttcctcactaacttagcctttgtggatttgtgctatacatcaaatgcaaccccgcagatgtcgactaatatcgtatctgagaagaccatttcctttgctggttgctttacacagtgctacattttcattgcccttctactcactgagttttacatgctggcagcaatggcctatgaccgctatgtggccatatatgaccctctgcgctacagtgtgaaaacgtccaggagagtttgcatctgcttggccacatttccctatgtctatggcttctcagatggactcttccaggccatcctgaccttccgcctgaccttctgtagatccaatgtcatcaaccacttctactgtgctgacccgccgctcattaagctttcttgttctgatacttatgtcaaagagcatgccatgttcatatctgctggcttcaacctctccagctccctcaccatcgtcttggtgtcctatgccttcattcttgctgccatcctccggatcaaatcagcagagggaaggcacaaggcattctccacctgtggttcccatatgatggctgtcaccctgttttatgggactctcttttgcatgtatataagaccaccaacagataagactgttgaggaatctaaaataatagctgtcttttacacctttgtgagtccggtacttaatccattgatctacagtctgaggaataaagatgtgaagcaggccttgaagaatgtcctgagatga

SEQ ID NO: 37 - protein, 311 aa, Homo sapiens
METKNYSSSTSGFILLGLSSNPKLQKPLFAIFLIMYLLTAVGNVLIILAIYSDPRLHTPMYFFLSNLSFMDICFTTVIVPKMLVNFLSETKIISYVGCLIQMYFFMAFGNTDSYLLASMAIDRLVAICNPLHYDVVMKPWHCLLMLLGSCSISHLHSLFRVLLMSRLSFCASHIIKHFFCDTQPVLKLSCSDTSSSQMVVMTETLAVIVTPFLCTIFSYLQIIVTVLRIPSAAGKWKAFSTCGSHLTVVVLFYGSVIYVYFRPLSMYSVMKGRVATVMYTVVTPMLNPFIYSLRNKDMKRGLKKLRHRIYS

SEQ ID NO: 38 - DNA, 936 bp, Homo sapiens
atggagacaaagaattatagcagcagcacctcaggcttcatcctcctgggcctctcttccaaccctaagctgcagaaacctctctttgccatcttcctcatcatgtacctactcactgcggtggggaatgtgctcatcatcctggccatctactctgaccccaggctccacacccctatgtacttttttctcagcaacttgtctttcatggatatctgcttcacaacagtcatagtgcctaagatgctggtgaattttctatcagagacaaagattatctcttatgtgggctgcctgatccagatgtacttcttcatggcatttgggaacactgacagctacctgctggcctctatggccatcgaccggctggtggccatctgcaaccccttacactatgatgtggttatgaaaccatggcattgcctactcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtaccatcttctcctacctgcaaatcatcgtcactgtgctcagaatcccctctgcagccgggaagtggaaggccttctctacctgtggctcccacctcactgtagtggtcctgttctatgggagtgtcatctatgtctattttaggcctctgtccatgtactcagtgatgaagggccgggtagccacagttatgtacacagtagtgacacccatgctgaaccctttcatctacagcctgaggaacaaagatatgaaaaggggtttgaagaaattaagacacagaatttactcatag

SEQ ID NO: 39 - protein, 316 aa, Homo sapiens
MVEENHTMKNEFILTGFTDHPELKTLLFVVFFAIYLITVVGNISLVALIFTHCRLHTPMYIFLGNLALVDSCCACAITPKMLENFFSEGKRISLYECAVQFYFLCTVETADCFLLAAVAYDRYVAICNPLQYHIMMSKKLCIQMTTGAFIAGNLHSMIHVGLVFRLVFCGLNHINHFYCDTLPLYRLSCVDPFINELVLFIFSGSVQVFTIGSVLISYLYILLTIFRMKSKEGRAKAFSTCASHFSSVSLFYGSIFFLYIRPNLLEEGGNDIPAAILFTIVVPLLNPFIYSLRNKEVISVLRKILLKIKSQGSVNK

SEQ ID NO: 40 - DNA, 951 bp, Homo sapiens
atggttgaagaaaatcataccatgaaaaatgagtttatcctcacaggatttacagatcaccctgagctgaagactctgctgtttgtggtgttctttgccatctatctgatcaccgtggtggggaatattagtttggtggcactgatatttacacactgtcggcttcacacaccaatgtacatctttctgggaaatctggctcttgtggattcttgctgtgcctgtgctattacccccaaaatgttagagaacttcttttctgagggcaaaaggatttccctctatgaatgtgcagtacagttttattttctttgcactgtggaaactgcagactgctttcttctggcagcagtggcctatgaccgctatgtggccatctgcaacccactgcagtaccacatcatgatgtccaagaaactctgcattcagatgaccacaggcgccttcatagctggaaatctgcattccatgattcatgtagggcttgtatttaggttagttttctgtggattgaatcacatcaaccacttttactgtgatactcttcccttgtatagactctcctgtgttgaccctttcatcaatgaactggttctattcatcttctcaggttcagttcaagtctttaccataggtagtgtcttaatatcttatctctatattcttcttactattttcagaatgaaatccaaggagggaagggccaaagccttttctacttgtgcatcccacttttcatcagtttcattattctatggatctatttttttcctatacattagaccaaatttgcttgaagaaggaggtaatgatataccagctgctattttatttacaatagtagttcccttactaaatcctttcatttatagtctgagaaacaaggaagtaataagtgtcttaagaaaaattctgctgaaaataaaatctcaaggaagtgtgaacaaatga

SEQ ID NO: 41 - protein, 299 aa, Homo sapiens
MEPRKNVTDFVLLGFTQNPKEQKVLFVMFLLFYILTMVGNLLIVVTVTVSETLGSPMSFFLAGLTFIDIIYSSSISPRLISDLFFGNNSISFQSFMAQLFIEHLFGGSEVFLLLVMAYDRYVAICKPLHYLVIMRQWVCVLLLVVSWVGGFLQSVFQLSIIYGLPFCGPNVIDHFFCDMYPLLKLACTDTHVIGLLVVANGGLSCTIAFLLLLISYGVILHSLKKLSQKGRQKAHSTCSSHITVVVFFFVPCIFMCARPARTFSIDKSVSVFYTVITPMLNPLIYTLRNSEMTSAMKKL

SEQ ID NO: 42 - DNA, 900 bp, Homo sapiens
atggagccaaggaaaaatgtgactgactttgtcctcttgggcttcacacagaatccaaaggagcagaaagtactttttgttatgttcttgctcttctacattttgaccatggtgggcaacctgctcattgtagtgaccgtaactgtcagtgagaccctgggctcaccaatgtccttctttcttgctggcttaacatttatagatatcatttattcttcatccatttcccccagattgatttcagacttgttctttgggaataattccatatccttccaatctttcatggcccagctctttatcgagcacctttttggtgggtcagaggtctttctcctgttggtgatggcctatgaccgctatgtggccatctgtaagcccttgcattatttggttatcatgagacaatgggtgtgtgttttgctgctggtagtgtcctgggttggaggatttctgcaatcagtatttcaacttagcattatttatgggctcccattctgtggccccaatgtcattgatcattttttctgtgacatgtatcccttattgaaactggcctgcactgacacccatgttattggcctcttagtggtggccaatggaggactgtcttgcactattgcgtttctgctcttactcatctcttatggtgtcatcctgcactctctaaagaaacttagtcagaaagggaggcaaaaagcccactcaacctgcagttcccacatcactgtggttgtcttcttctttgttccttgtatttttatgtgtgctagacctgctaggaccttctccattgacaaatcagtgagtgtgttttatacagtcataaccccaatgctgaaccccttaatctacactctgagaaattctgagatgacaagtgctatgaagaagctttag

SEQ ID NO: 43 - protein, 315 aa, Homo sapiens
  MOD_RES (3)..(4): Variable amino acid
  MOD_RES (6): Variable amino acid
  MOD_RES (22): Variable amino acid
  MOD_RES (34)..(35): Variable amino acid
  MOD_RES (52): Variable amino acid
  MOD_RES (145)..(146): Variable amino acid
  MOD_RES (169): Variable amino acid
MRXXNNXTEFVLLGFSQDPGVXKALFVMFLLTYXXTVVGNLLIVVDIIASPXLGSPMYFFLACLSFIDAAYSTTISPKLIVGLFCDKKTISFQGCMGQLFIDHFFGGAEVFLLVVMACDRYVAICKPLHYLTIMNRQVCFLLLVXXMIGGFVHSAFQIVVYSLPFCGPXVIVHFSCDMHPLLELACTDTYFIGLTVVVNSGAICMVIFNLLLISYGVILSSLKTYSQEKRGKALSTCSSGSTVVVLFFVPCIFIYVRPVSNFPTDKFMTVFYTIITHMLSPLIYTLRNSEMRNAIEKLLGKKLTIFIIGGVSVLM

SEQ ID NO: 44 - DNA, 948 bp, Homo sapiens
  modified_base (9)..(12): A, T, C or G
  modified_base (21): A, T, C or G
  modified_base (64)..(66): A, T, C or G
  modified_base (100)..(105): A, T, C or G
  modified_base (132): A, T, C or G
  modified_base (155)..(156): A, T, C or G
  modified_base (432)..(433): A, T, C or G
  modified_base (505): A, T, C or G
atgagacannnnaacaatatnacagaatttgtcctcctgggcttttctcaggatcctggtgtgnnnaaagcattatttgtcatgtttttactcacatacnnnnnnacagtggtggggaacctgctcattgtngtggatattattgccagcccttnnttgggttccccaatgtatttcttccttgcctgcctgtcatttatagatgctgcatattccactaccatttctcccaagttaattgtaggcttattctgtgataaaaagactatttccttccaaggttgcatgggccagctatttatagaccatttctttggtggggctgaggtcttccttctggtggtgatggcctgtgatcgctatgtggccatctgtaagccactgcactatttgaccatcatgaatcgacaggtttgcttccttctgttggtnntnnccatgattggaggttttgtacattctgcgtttcaaattgttgtgtacagtctccctttctgtggtcccnatgtcattgttcatttcagttgtgacatgcacccattactggaactggcatgcactgacacctactttataggcctcactgttgttgtcaatagtggagcaatctgtatggtcattttcaaccttctgttaatctcctatggagtcatcctaagctcccttaaaacttacagtcaggaaaagaggggtaaagccttgtctacctgcagctccggcagtaccgttgttgtcctcttttttgtaccctgtattttcatatatgttagacctgtttcaaactttcctactgataagttcatgactgtgttttataccattatcacacacatgctgagtcctttaatatatacgttgagaaattcagagatgagaaatgctatagaaaaactcttgggtaaaaagttaactatatttattataggaggagtgtccgtcctcatgtag

SEQ ID NO: 45 - protein, 314 aa, Homo sapiens
MAKNNLTRVTEFILMGFMDHPKLEIPLFLVFLSFYLVTLLGNVGMIMLIQVDVKLYTPMYFFLSHLSLLDACYTSVITPQILATLATGKTVISYGHCAAQFFLFTICAGTECFLLAVMAYDRYAAIRNPLLYTVAMNPRLCWSLVVGAYVCGVSGAILRTTCTFTLSFCKDNQINFFFCDLPPLLKLACSDTANIEIVIIFFGNFVILANASVILISYLLIIKTILKVKSSGGRAKTFSTCASHITAVALFFGALIFMYLQSGSGKSLEEDKVVSVFYTVVIPMLNPLIYSLRNKDVKDAFRKVARRLQVSLSM

SEQ ID NO: 46 - DNA, 945 bp, Homo sapiens
atggccaagaataatctcaccagagtaaccgaattcattctcatgggctttatggaccaccccaaattggagattcccctctttctggtgtttctgagtttctacctagtcacccttcttgggaatgtggggatgattatgttaatccaagtagatgtcaaactctacaccccaatgtacttcttcctgagccacctctccctgctggatgcctgttacacctcagtcatcacccctcagatcctagccacattggccacaggcaaaacggtcatctcctacggccactgtgctgcccagttctttttattcaccatctgtgcaggcacagagtgctttctgctggcagtgatggcctatgatcgctatgctgccattcgcaacccactgctctataccgtggccatgaatcccaggctctgctggagcctggtggtaggagcctatgtctgtggggtgtcaggagccatcctgcgtaccacttgcaccttcaccctctccttctgtaaggacaatcaaataaacttcttcttctgtgacctcccacccctgctgaagcttgcctgcagtgacacagcaaacatcgagattgtcatcatcttctttggcaattttgtgattttggccaatgcctccgtcatcctgatttcctatctgctcatcatcaagaccattttgaaagtgaagtcttcaggtggcagggccaagactttctccacatgtgcctctcacatcactgctgtggcccttttctttggagcccttatcttcatgtatctgcaaagtggctcaggcaaatctctggaggaagacaaagtcgtgtctgtcttctatacagtggtcatccccatgctgaaccctctgatctacagcttaagaaacaaagatgtaaaagacgccttcagaaaggtcgctaggagactccaggtgtccctgagcatgtag

SEQ ID NO: 47 - protein, 307 aa, Homo sapiens
METGNLTWVSDFVFLGLSQTRELQRFLFLMFLFVYITTVMGNILIIITVTSDSQLHTPMYFLLRNLAVLDLCFSSVTAPKMLVDLLSEKKTISYQGCMGQIFFFHFLGGAMVFFLSVMAFDRLIAISRPLRYVTVMNTQLWVGLVVATWVGGFVHSIVQLALMLPLPFCGPNILDNFYCDVPQVLRLACTDTSLLEFLKISNSGLLDVVWFFLLLMSYLFILVMLRSHPGEARRKAASTCTTHIIVVSMIFVPSIYLYARPFTPFPMDKLVSIGHTVMTPMLNPMIYTLRNQDMQAAVRRLGRHRLV

SEQ ID NO: 48 - DNA, 924 bp, Homo sapiens
atggaaacagggaacctcacgtgggtatcagactttgtcttcctggggctctcgcagactcgggagctccagcgtttcctgtttctaatgttcctgtttgtctacatcaccactgttatgggaaacatccttatcatcatcacagtgacctctgattcccagctccacacacccatgtactttctgctccgaaacctggctgtcctagacctctgtttctcttcagtcactgctcccaaaatgctagtggacctcctctctgagaagaaaaccatctcttaccagggctgcatgggtcagatcttcttcttccactttttgggaggtgccatggtcttcttcctctcagtgatggcctttgaccgcctcattgccatctcccggcccctccgctatgtcaccgtcatgaacactcagctctgggtggggctggtggtagccacctgggtgggaggctttgtccactctattgtccagctggctctgatgctcccactgcccttctgtggccccaacattttggataacttctactgtgatgttccccaagtactgagacttgcctgcactgacacctcactgctggagttcctcaagatctccaacagtgggctgctggatgtcgtctggttcttcctcctcctgatgtcctacttattcatcctggtgatgctgaggtcacatccaggggaggcaagaaggaaggcagcttccacctgcaccacccacatcatcgtggtttccatgatcttcgttccaagcatttacctctatgcccggcccttcactccattccctatggacaagcttgtgtccatcggccacacagtcatgacccccatgctcaaccccatgatctataccctgaggaaccaggacatgcaggcagcagtgagaagattagggagacaccggctggtttga

SEQ ID NO: 49 - protein, 310 aa, Homo sapiens
MAAKNSSVTEFILEGLTHQPGLRIPLFFLFLGFYTVTVVGNLGLITLIGLNSHLHTPMYFFLFNLSLIDFCFSTTITPKMLMSFVSRKNIISFTGCMTQLFFFCFFVVSESFILSAMAYDRYVAICNPLLYTVTMSCQVCLLLLLGAYGMGFAGAMAHTGSIMNLTFCADNLVNHFMCDILPLLELSCNSSYMNELVVFIVVAVDVGMPIVTVFISYALILSSILHNSSTEGRSKAFSTCSSHIIVVSLFFGSGAFMYLKPLSILPLEQGKVSSLFYTIIVPVLNPLIYSLRNKDVKVALRRTLGRKIFS

SEQ ID NO: 50 - DNA, 933 bp, Homo sapiens
atggcagccaaaaactcttctgtgacagagtttatcctcgaaggcttaacccaccagccgggactgcggatccccctcttcttcctgtttctgggtttctacacggtcaccgtggtggggaacctgggcttgataaccctgattgggctgaactctcacctgcacactcccatgtacttcttcctttttaacctctctttaatagatttctgtttctccactaccatcactcccaaaatgctgatgagttttgtctcaaggaagaacatcatttccttcacagggtgtatgactcagctcttcttcttctgcttctttgtcgtctctgagtccttcatcctgtcagcgatggcgtatgaccgctacgtggccatctgtaacccactgttgtacacagtcaccatgtcttgccaggtgtgtttgctccttttgttgggtgcctatgggatggggtttgctggggccatggcccacacaggaagcataatgaacctgaccttctgtgctgacaaccttgtcaatcatttcatgtgtgacatccttcctctccttgagctctcctgcaacagctcttacatgaatgagctggtggtctttattgtggtggctgttgacgttggaatgcccattgtcactgtctttatttcttatgccctcatcctctccagcattctacacaacagttctacagaaggcaggtccaaagcctttagtacttgcagttcccacataattgtagtttctcttttctttggttctggtgctttcatgtatctcaaacccctttccatcctgcccctcgagcaagggaaagtgtcctccctgttctataccataatagtccccgtgttaaacccattaatctatagcttgaggaacaaggatgtcaaagttgccctgaggagaactttgggcagaaaaatcttttcttaa

SEQ ID NO: 51 - protein, 316 aa, Homo sapiens
MPSQNYSIISEFNLFGFSAFPQHLLPILFLLYLLMFLFTLLGNLLIMATIWIEHRLHTPMYLFLCTLSVSEILFTVAITPRMLADLLSTHHSITFVACANQMFFSFMFGFTHSFLLLVMGYDRYVAICHPLRYNVLMSPRDCAHLVACTWAGGSVMGMMVTTIVFHLTFCGSNVIHHFFCHVLSLLKLACENKTSSVIMGVMLVCVTALIGCLFLIILSYVFIVAAILRIPSAEGRHKTFSTCVSHLTVVVTHYSFASFIYLKPKGLHSMYSDALMATTYTVFTPFLSPIIFSLRNKELKNAINKNFYRKFCPPSS

SEQ ID NO: 52 - DNA, 951 bp, Homo sapiens
atgcctagtcagaactatagcatcatatctgaatttaacctctttggcttctcagccttcccccagcacctcctgcccatcttgttcctgctgtacctcctgatgttcctgttcacattgctgggcaaccttctcatcatggccacaatctggattgaacacagactccacacacccatgtacctcttcttgtgcaccctctccgtctctgagattctgttcactgttgccatcacccctcgcatgctggctgatctgctttccacccatcattccatcacctttgtggcttgtgccaaccagatgttcttctccttcatgtttggcttcactcactccttccttctcctggtcatgggctatgatcgctatgtggccatctgccacccactgcgttacaatgtgctcatgagcccccgtgactgtgcccatcttgtggcctgtacctgggctggtggctcagtcatggggatgatggtgacaacgatagttttccacctcactttctgtgggtctaatgtgatccaccattttttctgtcatgtgctttccctcttgaagttggcctgtgaaaacaagacatcatctgtcatcatgggtgtgatgctggtgtgtgtcacagccctgataggctgtttattcctcatcatcctctcctatgtcttcattgtggctgccatcttgaggattccctctgccgaaggccggcacaagacattttctacgtgtgtatcccacctcactgtggtggtcacgcactatagttttgcctcctttatctacctcaagcccaagggcctccattctatgtacagtgacgccttgatggccaccacctatactgtcttcacccccttccttagcccaatcattttcagcctaaggaacaaggagctgaagaatgccataaataaaaacttttacagaaaattctgtcctccaagttcctga

SEQ ID NO: 53 - protein, 310 aa, Homo sapiens
  MOD_RES (126): Variable amino acid
  MOD_RES (146): Variable amino acid
  MOD_RES (148): Variable amino acid
MPNFTDVTEFTLLGLTCRQELQVLFFVVFLAVYMITLLGNIGMIILISISPQLQSPMYFFLSHLSFADVCFSSNVTPKMLENLLSETKTISYVGCLVQCYFFIAVVHVEVYILAVMAFDRYMAGCXPLLYGSKMSRTVCVRLISVXYXYGFSVSLICTLWTYGLYFCGNFEINHFYCADPPLIQIACGRVHIKEITMIVIAGINFTYSLSVVLISYTLIVVAVLRMRSADGRRKAFSTCGSHLTAVSMFYGTPIFMYLRRPTEESVEQGKMVAVFYTTVIPMLNPMIYSLRNKDVKEAVNKAITKTYVRQ

SEQ ID NO: 54 - DNA, 933 bp, Homo sapiens
  modified_base (378): A, T, C or G
  modified_base (436)..(438): A, T, C or G
  modified_base (443)..(444): A, T, C or G
atgcctaatttcacggatgtgacagaatttactctcctggggctgacctgtcgtcaggagctacaggttctcttttttgtggtgttcctagcggtttacatgatcactctgttgggaaatattggtatgatcattttgattagcatcagtcctcagcttcagagtcccatgtactttttcctgagtcatctgtcttttgcggacgtgtgcttctcctccaacgttacccccaaaatgctggaaaacttattatcagagacaaaaaccatttcctatgtgggatgcttggtgcagtgctactttttcattgccgttgtccacgtggaggtctatatcctggctgtgatggcctttgacaggtacatggccggctgcaancctctgctttatggcagtaaaatgtctaggactgtgtgtgttcggctcatctctgtgnnntatgnntatggattctctgtcagcctaatatgcacactatggacttatggcttatacttctgtggaaactttgaaatcaatcacttctattgtgcagatccccctctcatccagattgcctgtgggagagtgcacatcaaagaaatcacaatgattgttattgctggaattaacttcacatattccctctcggtggtcctcatctcctacactctcattgtagtagctgtgctacgcatgcgctctgccgatggcaggaggaaggcgttctccacctgtgggtcccacttgacggctgtttctatgttttatgggacccccatcttcatgtatctcaggagacccactgaggaatccgtagagcagggcaaaatggtggctgtgttttacaccacagtaattcctatgttgaatcccatgatctacagtctgagaaataaggatgtaaaagaagcagtcaacaaagcaatcaccaagacatatgtgaggcagtaa

SEQ ID NO: 55 - protein, 318 aa, Homo sapiens
MMSFAPNASHSPVFLLLGFSRANISYTLLFFLFLAIYLTTILGNVTLVLLISWDSRLHSPMYYLLRGLSVIDMGLSTVTLPQLLAHLVSHYPTIPAARCLAQFFFFYAFGVTDTLVIAVMALDRYVAICDPLHYALVMNHQRCACLLALSWVVSILHTMLRVGLVLPLCWTGDAGGNVNLPHFFCDHRPLLRASCSDIHSNELAIFFEGGFLMLGPCALIVLSYVRIGAAILRLPSAAGRRRAVSTCGSHLTMVGFLYGTIICVYFQPPFQNSQYQDMVASVMYTAITPLANPFVYSLHNKDVKGALCRLLEWVKVDP

SEQ ID NO: 56 - DNA, 957 bp, Homo sapiens
atgatgagctttgcccctaatgcttcacactctccggtttttttgctccttgggttctcgagagctaacatctcctacactctcctcttcttcctgttcctggctatttacctgaccaccatactggggaatgtgacactggtgctgctcatctcctgggactccagactgcactcacccatgtattatctgcttcgtggcctctctgtgatagacatggggctatccacagttacactgccccagttgctggcccatttggtctctcattacccaaccattcctgctgcccgctgcttggctcagttctttttcttctatgcatttggggttacagatacacttgtcattgctgtcatggctctggatcgctatgtggccatctgtgaccccctgcactatgctttggtaatgaatcaccaacggtgtgcctgcttactagccttgagctgggtggtgtccatactgcacaccatgttgcgtgtgggactcgtcctgcctctttgctggactggggatgctgggggcaacgttaaccttcctcacttcttttgtgaccaccggccacttctgcgagcctcttgttctgacatacattctaatgagctggccatattctttgagggtggcttccttatgctgggcccctgtgccctcattgtactctcttatgtccgaattggggccgctattctacgtttgccttcagctgctggtcgccgccgagcagtctccacctgtggatcccacctcaccatggttggtttcctctacggcaccatcatttgtgtctacttccagcctcccttccagaactctcagtatcaggacatggtggcttcagtaatgtatactgccattacacctttggccaacccatttgtgtatagcctccacaataaggatgtcaagggtgcactctgcaggctgcttgaatgggtgaaggtagacccctga

SEQ ID NO: 57 - protein, 326 aa, Homo sapiens
  MOD_RES (142)..(143): Variable amino acid
MGFLSPMHPCRPPTQRRMAAGNHSTVTEFILKGLTKRADLQLPLFLLFLGIYLVTIVGNLGMITLICLNSQLHTPMYYFLSNLSLMDLCYSSVITPKMLVNFVSEKNIISYAGCMSQLYFFLVFVIAECYMLTVMAYDRYVXXCHPLLYNIIMSHHTCLLLVAVVYAIGLIGSTIETGLMLKLPYCEHLISHYFCDILPLMKLSCSSTYDVEMTVFFSAGFNIIVTSLTVLVSYTFILSSILGISTTEGRSKAFSTCSSHLAAVGMFYGSTAFMYLKPSTISSLTQENVASVFYTTVIPMLNPLIYSLRNKEVKAAVQKTLRGKLF

SEQ ID NO: 58 - DNA, 981 bp, Homo sapiens
  modified_base (425): A, T, C or G
  modified_base (427): A, T, C or G
atggggttcttgtctcccatgcatccctgcaggcctcccacccagaggagaatggctgcaggaaatcactctacagtgacagagttcattctcaagggtttaacgaagagagcagacctccagctccccctctttctcctcttcctcgggatctacttggtcaccatcgtggggaacctgggcatgatcactctaatttgtctgaactctcagctgcacacccccatgtactactttctcagcaatctgtcactcatggatctctgctactcctccgtcattacccctaagatgctggtgaactttgtgtcagagaaaaacatcatctcctacgcagggtgcatgtcacagctctacttcttccttgtttttgtcattgctgagtgttacatgctgacagtgatggcctacgaccgctatgttgncntctgccaccctttgctttacaacatcattatgtctcatcacacctgcctgctgctggtggctgtggtctacgccatcggactcattggctccacaatagaaactggcctcatgttaaaactgccctattgtgagcacctcatcagtcactacttctgtgacatcctccctctcatgaagctgtcctgctctagcacctatgatgttgagatgacagtcttcttttcggctggattcaacatcatagtcacgagcttaacagttcttgtttcttacaccttcattctctccagcatcctcggcatcagcaccacagaggggagatccaaagccttcagcacctgcagctcccaccttgcagccgtgggaatgttctatggatcaactgcattcatgtacttaaaaccctccacaatcagttccttgacccaggagaatgtggcctctgtgttctacaccacggtaatccccatgttgaatcccctaatctacagcctgaggaacaaggaagtaaaggctgccgtgcagaaaacgctgaggggtaaactgttttga

SEQ ID NO: 59 - protein, 311 aa, Homo sapiens
MGTGNDTTVVEFTLLGLSEDTTVCAILFLVFLGIYVVTLMGNISIIVLIRRSHHLHTPMYIFLCHLAFVDIGYSSSVTPVMLMSFLRKETSLPVAGCVAQLCSVVTFGTAECFLLAAMAYDRYVAICSPLLYSTCMSPGVCIILVGMSYLGGCVNAWTFIGCLLRLSFCGPNKVNHFFCDYSPLLKLACSHDFTFEIIPAISSGSIIVATVCVIAISYIYILITILKMHSTKGRHKAFSTCTSHLTAVTLFYGTITFIYVMPKSSYSTDQNKVVSVFYTVVIPMLNPLIYSLRNKEIKGALKRELRIKIFS

SEQ ID NO: 60 - DNA, 936 bp, Homo sapiens
atggggactggaaatgacaccactgtggtagagtttactcttttggggttatctgaggatactacagtttgtgctattttatttcttgtgtttctaggaatttatgttgtcaccttaatgggtaatatcagcataattgtattgatcagaagaagtcatcatcttcatacacccatgtacattttcctctgccatttggcctttgtagacattgggtactcctcatcagtcacacctgtcatgctcatgagcttcctaaggaaagaaacctctctccctgttgctggttgtgtggcccagctctgttctgtagtgacgtttggtacggccgagtgcttcctgctggctgccatggcctatgatcgctatgtggccatctgctcacccctgctctactctacctgcatgtcccctggagtctgcatcatcttagtgggcatgtcctacctgggtggatgtgtgaatgcttggacattcattggctgcttattaagactgtccttctgtgggccaaataaagtcaatcactttttctgtgactattcaccacttttgaagcttgcttgttcccatgattttacttttgaaataattccagctatctcttctggatctatcattgtggccactgtgtgtgtcatagccatatcctacatctatatcctcatcaccatcctgaagatgcactccaccaagggccgccacaaggccttctccacctgcacctcccacctcactgcagtcactctgttctatgggaccattaccttcatttatgtgatgcccaagtccagctactcaactgaccagaacaaggtggtgtctgtgttctacaccgtggtgattcccatgttgaaccccctgatctacagcctcaggaacaaggagattaagggggctctgaagagagagcttagaataaaaatattttcttga

SEQ ID NO: 61 - protein, 322 aa, Homo sapiens
MNSLKDGNHTALTGFILLGLTDDPILRVILFMIILSGNLSIIILIRISSQLHHPMYFFLSHLAFADMAYSSSVTPNMLVNFLVERNTVSYLGCAIQLGSAAFFATVECVLLAAMAYDRFVAICSPLLYSTKMSTQVSVQLLLVVYIAGFLIAVSYTTSFYFLLFCGPNQVNHFFCDFAPLLELSCSDISVSTVVLSFSSGSIIVVTVCVIAVCYIYILITILKMRSTEGHHKAFSTCTSHLTVVTLFYGTITFIYVMPNFSYSTDQNKVVSVLYTVVIPMLNPLIYSLRNKEIKGALKRELVRKILSHDACYFSRTSNNDIT

SEQ ID NO: 62 - DNA, 969 bp, Homo sapiens
atgaattccctgaaggacgggaatcacaccgctctgacggggttcatcctattgggcttaacagatgatccaatccttcgagtcatcctcttcatgatcatcctatctggtaatctcagcataattattcttatcagaatttcttctcagctccatcatcctatgtatttctttctgagccacttggcttttgctgacatggcctattcatcttctgtcacacccaacatgcttgtaaacttcctggtggagagaaatacagtctcctaccttggatgtgccatccagcttggttcagcggctttctttgcaacagtcgaatgcgtccttctggctgccatggcctatgaccgctttgtggcaatttgcagtccactgctttattcaaccaaaatgtccacacaagtcagtgtccagctactcttagtagtttacatagctggttttctcattgctgtctcctatactacttccttctattttttactcttctgtggaccaaatcaagtcaatcattttttctgtgatttcgctcccttacttgaactctcctgttctgatatcagtgtctccacagttgttctctcattttcttctggatccatcattgtggtcactgtgtgtgtcatagccgtctgctacatctatatcctcatcaccatcctgaagatgcgctccactgaggggcaccacaaggccttctccacctgcacttcccacctcactgtggttaccctgttctatgggaccattaccttcatttatgtgatgcccaattttagctactcaactgaccagaacaaggtggtgtctgtgttgtacacagtggtgattcccatgttgaaccccctgatctacagcctcaggaacaaggagattaagggggctctgaagagagagcttgttagaaaaatactttctcatgatgcttgttattttagtagaacttcaaataatgatattacatag

SEQ ID NO: 63 - protein, 332 aa, Homo sapiens
MLEGVEHLLLLLLLTDVNSKELQSGNQTSVSHFILVGLHHPPQLGAPLFLAFLVIYLLTVSGNGLIILTVLVDIRLHRPMCLFLCHLSFLDMTISCAIVPKMLAGFLLGSRIISFGGCVIQLFSFHFLGCTECFLYTLMAYDRFLAICKPLHYATIMTHRVCNSLALGTWLGGTIHSLFQTSFVFRLPFCGPNRVDYIFCDIPAMLRLACADTAINELVTFADIGFLALTCFMLILTSYGYIVAAILRIPSADGRRNAFSTCAAHLTVVIVYYVPCTFIYLRPCSQEPLDGVVAVFYTVITPLLNSIIYTLCNKEMKAALQRLGGHKEVQPH

SEQ ID NO: 64 - DNA, 999 bp, Homo sapiens
atgttagagggtgttgagcatctccttctgctacttcttttgacagatgtgaacagcaaggaactgcaaagtggaaaccagacttctgtgtctcacttcattttggtgggcctgcaccacccaccacagctgggagcgccactcttcttagctttccttgtcatctatctcctcactgtttctggaaatgggctcatcatcctcactgtcttagtggacatccggctccatcgtcccatgtgcttgttcctgtgtcacctctccttcttggacatgaccatttcttgtgctattgtccccaagatgctggctggctttctcttgggtagtaggattatctcctttgggggctgtgtaatccaactattttctttccatttcctgggctgtactgagtgcttcctttacacactcatggcttatgaccgtttccttgccatttgtaagcccttacactatgctaccatcatgacccacagagtctgtaactccctggctttaggcacctggctgggagggactatccattcacttttccaaacaagttttgtattccggctgcccttctgtggccccaatcgggtcgactacatcttctgtgacattcctgccatgctgcgtctagcctgcgccgatacggccatcaacgagctggtcacctttgcagacattggcttcctggccctcacctgcttcatgctcatcctcacttcctatggctatattgtagctgccatcctgcgaattccgtcagcagatgggcgccgcaatgccttctccacttgtgctgcccacctcactgttgtcattgtttactatgtgccctgcaccttcatttacctgcggccttgttcacaggagcccctggatggggtggtagctgtcttttacactgtcatcactcccttgcttaactccatcatctacacactgtgcaacaaagaaatgaaggcagcattacagaggctagggggccacaaggaagtgcagcctcactga

SEQ ID NO: 65 - protein, 312 aa, Homo sapiens
MEPLNRTEVSEFFLKGFSGYPALEHLLFPLCSAMYLVTLLGNTAIMAVSVLDIHLHTPVYFFLGNLSTLDICYTPTFVPLMLVHLLSSRKTISFAVCAIQMCLSLSTGSTECLLLAITAYDRYLAICQPLRYHVLMSHRLCVLLMGAAWVLCLLKSVTEMVISMRLPFCGHHVVSHFTCKILAVLKLACGNTSVSEDFLLAGSILLLPVPLAFICLSYLLILATILRVPSAARCCKAFSTCLAHLAVVLLFYGTIIFMYLKPKSKEAHISDEVFTVLYAMVTTMLNPTIYSLRNKEVKEAARKVWGRSRASR

SEQ ID NO: 66 - DNA, 939 bp, Homo sapiens
atggagccgctcaacagaacagaggtgtccgagttctttctgaaaggattttctggctacccagccctggagcatctgctcttccctctgtgctcagccatgtacctggtgaccctcctggggaacacagccatcatggcggtgagcgtgctagatatccacctgcacacgcccgtgtacttcttcctgggcaacctctctaccctggacatctgctacacgcccacctttgtgcctctgatgctggtccacctcctgtcatcccggaagaccatctcctttgctgtctgtgccatccagatgtgtctgagcctgtccacgggctccacggagtgcctgctactggccatcacggcctatgaccgctacctggccatctgccagccactcaggtaccacgtgctcatgagccaccggctctgcgtgctgctgatgggagctgcctgggtcctctgcctcctcaagtcggtgactgagatggtcatctccatgaggctgcccttctgtggccaccacgtggtcagtcacttcacctgcaagatcctggcagtgctgaagctggcatgcggcaacacgtcggtcagcgaagacttcctgctggcgggctccatcctgctgctgcctgtacccctggcattcatctgcctgtcctacttgctcatcctggccaccatcctgagggtgccctcggccgccaggtgctgcaaagccttctccacctgcttggcacacctggctgtagtgctgcttttctacggcaccatcatcttcatgtacttgaagcccaagagtaaggaagcccacatctctgatgaggtcttcacagtcctctatgccatggtcacgaccatgctgaaccccaccatctacagcctgaggaacaaggaggtgaaggaggccgccaggaaggtgtggggcaggagtcgggcctccaggtga

SEQ ID NO: 67 - protein, 305 aa, Homo sapiens [sequence omitted]

SEQ ID NO: 68 - DNA, 918 bp, Homo sapiens
atgtatctggtcacggtgctgaggaacctgctcagcatcctggctgtcagctctgactcccacccccacacacccatgtacttcttcctctccaacctgtgctgggctgacatcggtttcaccttggccacggttcccaaaatgattgtggacatggggtcgcatagcaaagtcatctcttatgggggctgcctgacacagatgtctttcttggtactttttgcatgtatagtagacatgttcctgactgtgatggcttatgactgctttgtagccatctgtcgccctctgcactacccagtcatcgtgaatcctcacctctgtgtcttcttcgttttggtgtcctttttccttagcctgttggattcccagctgcacagttggattgtgttacaattcaccttcttcaagaatgtggaaatctctaattttgtctgtgagccatctcaacttctcaagcttgcctcttatgacagcgtcatcaatagcatattcatatattttgataatactatgtttggttttcttcccatttcagggatccttttgtcttactataaaattgtcccctccattctaaggatttcatcatcagatgggaagtacaaagccttctcagcctgtggctgtcacctggcagttgtttgcttattttatggaacaggcattggcgtgtacctgacttcagctgtggcaccacccctcaggaatggtatggtggcgtcagtgatgtacgctgtggtcacccccatgctgaaccctttcatctacagcctgagaaacagggacattcaaagtgccctgtggagggtgtgcaacaaaacagtcgaatctcatgatctgttccatcctttttcttgtgtggttgagaaagggcaaccacattcaatccctacatctgcaaatcctgccccttag

SEQ ID NO: 69 - protein, 319 aa, Homo sapiens
MEKANETSPVMGFVLLRLSAHPELEKTFFVLILLMYLVILLGNGVLILVTILDSRLHTPMYFFLGNLSFLDICFTTSSVPLVLDSFLTPQETISFSACAVQMALSFAMAGTECLLLSMMAFDRYVAICNPLRYSVIMSKAAYMPMAASSWAIGGAASVVHTSLAIQLPFCGDNVINHFTCEILAVLKLACADISINVISMEVTNVIFLGVPVLFISFSYVFIITTILRIPSAEGRKKVFSTCSAHLTVVIVFYGTLFFMYGKPKSKDSMGADKEDLSDKLIPLFYGVVTPMLNPIIYSLRNKDVKAAVRRLLRPKGFTQ

SEQ ID NO: 70 - DNA, 960 bp, Homo sapiens
atggaaaaagccaatgagacctcccctgtgatggggttcgttctcctgaggctctctgcccacccagagctggaaaagacattcttcgtgctcatcctgctgatgtacctcgtgatcctgctgggcaatggggtcctcatcctggtgaccatccttgactcccgcctgcacacgcccatgtacttcttcctagggaacctctccttcctggacatctgcttcactacctcctcagtcccactggtcctggacagctttttgactccccaggaaaccatctccttctcagcctgtgctgtgcagatggcactctcctttgccatggcaggaacagagtgcttgctcctgagcatgatggcatttgatcgctatgtggccatctgcaacccccttaggtactccgtgatcatgagcaaggctgcctacatgcccatggctgccagctcctgggctattggtggtgctgcttccgtggtacacacatccttggcaattcagctgcccttctgtggagacaatgtcatcaaccacttcacctgtgagattctggctgttctaaagttggcctgtgctgacatttccatcaatgtgatcagcatggaggtgacgaatgtgatcttcctaggagtcccggttctgttcatctctttctcctatgtcttcatcatcaccaccatcctgaggatcccctcagctgaggggaggaaaaaggtcttctccacctgctctgcccacctcaccgtggtgatcgtcttctacgggaccttattcttcatgtatgggaagcctaagtctaaggactccatgggagcagacaaagaggatctttcagacaaactcatcccccttttctatggggtggtgaccccgatgctcaaccccatcatctatagcctgaggaacaaggatgtgaaggctgctgtgaggagactgctgagaccaaaaggcttcactcagtga

SEQ ID NO: 71 - protein, 300 aa, Homo sapiens [sequence omitted]

SEQ ID NO: 72 - DNA, 903 bp, Homo sapiens
atgtacctggtcacggtgctgaggaacctgctcatcatcctggctgtcagctctgactcccacctccacacccccatgtgcttcttcctctccaacctgtgctgggctgacatcggtttcacctcggccatggttcccaagatgattgtggacatgcagtcgcatagcagagtcatctcttatgcgggctgcctgacacagatgtctttctttgtcctttttgcatgtatagaagacatgctcctgacagtgatggcctatgaccgatttgtggccatctgtcaccccctgcactacccagtcatcatgaatcctcaccttggtgtcttcttagttttggtgtcctttttcctcagcctgttggattcccagctgcacagttggattgtgttacaattcaccttcttcaagaatgtggaaatctccaattttgtctgtgacccatctcaacttctcaaccttgcctgttctgacagtgtcatcaatagcatattcatatatttagatagtattatgtttggttttcttcccatttcagggatccttttgtcttacgctaacaatgtcccctccattctaagaatttcatcatcagataggaagtctaaagccttctccacctgtggctctcacctggcagttgtttgcttattttatggaacaggcattggcgtgtacctgacttcagctgtgtcaccaccccccaggaatggtgtggtggcatcagtgatgtacgctgtggtcacccccatgctgaaccctttcatctacagcctgagaaatagggacattcaaagtgccctgtggaggctgcgcagcagaacagtcgaatctcatgatctgttatctcaagatctgctccatcctttttcttgtgtgggtgagaaaggtcaaccacattaa

SEQ ID NO: 73 - protein, 314 aa, Homo sapiens
MGVKNHSTVTEFLLSGLTEQAELQLPLFCLFLGIYTVTVVGNLSMISIIRLNRQLHTPMYYFLSSLSFLDFCYSSVITPKMLSGFLCRDRSISYSGCMIQLFFFCVCVISECYMLAAMACDRYVAICSPLLYRVIMSPRVCSLLVAAVFSVGFTDAVIHGGCILRLSFCGSNIIKHYFCDIVPLIKLSCSSTYIDELLIFVIGGFNMVATSLTIIISYAFILTSILRIHSKKGRCKAFSTCSSHLTAVLMFYGSLMSMYLKPASSSSLTQEKVSSVFYTTVILMLNPLIYSLRNNEVRNALMKLLRRKISLSPG

SEQ ID NO: 74 - DNA, 945 bp, Homo sapiens
atgggtgtaaaaaaccattccacagtgactgagtttcttctttcaggattaactgaacaagcagagcttcagctgcccctcttctgcctcttcttaggaatttacacagttactgtggtgggaaacctcagcatgatctcaattattaggctgaatcgtcaacttcatacccccatgtactatttcctgagtagtttgtcttttttagatttctgctattcttctgtcattacccctaaaatgctatcagggtttttatgcagagatagatccatctcctattctggatgcatgattcagctgttttttttctgtgtttgtgttatttctgaatgctacatgctggcagccatggcctgcgatcgctacgtggccatctgcagcccactgctctacagggtcatcatgtcccctagggtctgttctctgctggtggctgctgtcttctcagtaggtttcactgatgctgtgatccatggaggttgtatactcaggttgtctttctgtggatcaaacatcattaaacattatttctgtgacattgtccctcttattaaactctcctgctccagcacttatattgatgagcttttgatttttgtcattggtggatttaacatggtggccacaagcctaacaatcattatttcatatgcttttatcctcaccagcatcctgcgcatccactctaaaaagggcaggtgcaaagcgtttagcacctgtagctcccacctgacagctgttcttatgttttatgggtctctgatgtccatgtatctcaaacctgcttctagcagttcactcacccaggagaaagtatcctcagtattttataccactgtgattctcatgttgaatcccttgatatatagtctgaggaacaatgaagtaagaaatgctctgatgaaacttttaagaagaaaaatatctttatctccaggataa

SEQ ID NO: 75 - protein, 311 aa, Homo sapiens
MSNATLLTAFILTGLPHAPGLDAPLFGIFLVVYVLTVLGNLLILLVIRVDSHLHTPMYYFLTNLSFIDMWFSTVTVPKMLMTLVSPSGRTISFHSCVAQLYFFHFLGSTECFLYTVMSYDRYLAISYPLRYTNMMTGRSCALLATGTWLSGSLHSAVQTILTFHLPYCGPNQIQHYFCDAPPILKLACADTSANEMVIFVNIGLVASGCFVLIVLSYVSIVCSILRIRTSEGRHRAFQTCASHCIVVLCFFGPGLFIYLRPGSRDALHGVVAVFYTTLTPLFNPVVYTLRNKEVKKALLKLKNGSVFAQGE

SEQ ID NO: 76 - DNA, 936 bp, Homo sapiens
atgtccaacgccaccctactgacagcgttcatcctcacgggccttccccatgccccagggctggacgcccccctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcaggactatctccttccacagctgcgtggctcagctctattttttccacttcctggggagcaccgagtgtttcctctacacagtcatgtcctatgatcgctacctggccatcagttacccgctcaggtacaccaacatgatgactgggcgctcgtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgagatggtcatctttgtgaatattgggctagtggcctcgggctgctttgtcctgatagtgctgtcctatgtgtccatcgtctgttccatcctgcggatccgcacctcagaggggaggcacagagcctttcagacctgtgcctcccactgtatcgtggtcctttgcttctttggccctggtcttttcatttacctgaggccaggctccagggacgccttgcatggggttgtggccgttttctacaccacgctgactcctcttttcaaccctgttgtgtacaccctgagaaacaaggaggtaaagaaagctctgttgaagctgaaaaatgggtcagtatttgctcagggtgaatag

SEQ ID NO: 77 - protein, 323 aa, Homo sapiens
MNPENWTQVTSFVLLGFPSSHLIQFLVFLGLMVTYIVTATGKLLIIVLSWIDQRLHIQMYFFLRNFSFLELLLVTVVVPKMLVVILTGDHTISFVSCIIQSYLYFFLGTTDFFLLAVMSLDRYLAICRPLRYETLMNGHVCSQLVLASWLAGFLWVLCPTVLMASLPFCGPNGIDHFFRDSWPLLRLSCGDTHLLKLVAFMLSTLVLLGSLALTSVSYACILATVLRAPTAAERRKAFSTCASHLTVVVIIYGSSIFLYIRMSEAQSKLLNKGASVLSCIITPLLNPFIFTLRNDKVQQALREALGWPRLTAVMKLRVTSQRK

SEQ ID NO: 78 - DNA, 972 bp, Homo sapiens
atgaaccctgaaaactggactcaggtaacaagctttgtccttctgggtttccccagtagccacctcatacagttcctggtgttcctggggttaatggtgacctacattgtaacagccacaggcaagctgctaattattgtgctcagctggatagaccaacgcctgcacatacagatgtacttcttcctgcggaatttctccttcctggagctgttgctggtaactgttgtggttcccaagatgcttgtcgtcatcctcacgggggatcacaccatctcatttgtcagctgcatcatccagtcctacctctacttctttctaggcaccactgacttcttcctcttggccgtcatgtctctggatcgttacctggcaatctgccgaccactccgctatgagaccctgatgaatggccatgtctgttcccaactagtgctggcctcctggctagctggattcctctgggtcctttgccccactgtcctcatggccagcctgcctttctgtggccccaatggtattgaccacttctttcgtgacagttggcccttgctcaggctttcttgtggggacacccacctgctgaaactggtggctttcatgctctctacgttggtgttactgggctcactggctctgacctcagtttcctatgcctgcattcttgccactgttctcagggcccctacagctgctgagcgaaggaaagcgttttccacttgcgcctcgcatcttacagtggtggtcatcatctatggcagttccatctttctctacattcgtatgtcagaggctcagtccaaactgctcaacaaaggtgcctccgtcctgagctgcatcatcacacccctcttgaacccattcatcttcactctccgcaatgacaaggtgcagcaagcactgagagaagccttggggtggcccaggctcactgctgtgatgaaactgagggtcacaagtcaaaggaaatga

SEQ ID NO: 79 - protein, 318 aa, Homo sapiens
MNPANHSQVAGFVLLGLSQVWELRFVFFTVFSAVYFMTVVGNLLIVVIVTSDPHLHTTMYFLLGNLSFLDFCYSSITAPRMLVDLLSGNPTISFGGCLTQLFFFHFIGGIKIFLLTVMAYDRYIAISQPLHYTLIMNQTVCALLMAASWVGGFIHSIVQIALTIQLPFCGPDKLDNFYCDVPQLIKLACTDTFVLELLMVSNNGLVTLMCFLVLLGSYTALLVMLRSHSREGRSKALSTCASHIAVVTLIFVPCIYVYTRPFRTFPMDKAVSVLYTIVTPMLNPAIYTLRNKEVIMAMKKLWRRKKDPIGPLEHRPLH

SEQ ID NO: 80 - DNA, 957 bp, Homo sapiens
atgaatccagcaaatcattcccaggtggcaggatttgttctactggggctctctcaggtttgggagcttcggtttgttttcttcactgttttctctgctgtgtattttatgactgtagtgggaaaccttcttattgtggtcatagtgacctccgacccacacctgcacacaaccatgtattttctcttgggcaatctttctttcctggacttttgctactcttccatcacagcacctaggatgctggttgacttgctctcaggcaaccctaccatttcctttggtggatgcctgactcaactcttcttcttccacttcattggaggcatcaagatcttcctgctgactgtcatggcgtatgaccgctacattgccatttcccagcccctgcactacacgctcattatgaatcagactgtctgtgcactccttatggcagcctcctgggtggggggcttcatccactccatagtacagattgcattgactatccagctgccattctgtgggcctgacaagctggacaacttttattgtgatgtgcctcagctgatcaaattggcctgcacagatacctttgtcttagagcttttaatggtgtctaacaatggcctggtgaccctgatgtgttttctggtgcttctgggatcgtacacagcactgctagtcatgctccgaagccactcacgggagggccgcagcaaggccctgtctacctgtgcctctcacattgctgtggtgaccttaatctttgtgccttgcatctacgtctatacaaggccttttcggacattccccatggacaaggccgtctctgtgctatacacaattgtcacccccatgctgaatcctgccatctataccctgagaaacaaggaagtgatcatggccatgaagaagctgtggaggaggaaaaaggaccctattggtcccctggagcacagacccttacattag

SEQ ID NO: 81 - protein, 324 aa, Homo sapiens
MQKPQLLVPIIATSNGNLVHAAYFLLVGIPGLGPTIHFWLAFPLCFMYALATLGNLTIVLIIRVERRLHEPMYLFLAMLSTIDLVLSSITMPKMASLFLMGIQEIEFNICLAQMFLIHALSAVESAVLLAMAFDRFVAICHPLRHASVLTGCTVAKIGLSALTRGFVFFFPLPFILKWLSYCQTHTVTHSFCLHQDIMKLSCTDTRVNVVYGLFIILSVMGVDSLFIGFSYILILWAVLELSSRRAALKAFNTCISHLCAVLVFYVPLIGLSVVHRLGGPTSLLHVVMANTYLLLPPVVNPLVYGAKTKEICSRVLCMFSQGGK

SEQ ID NO: 82 - DNA, 975 bp, Homo sapiens
atgcagaagccccagctcttggtccctatcatagccacttcaaatggaaatctggtccacgcagcatacttccttttggtgggtatccctggcctggggcctaccatacacttttggctggctttcccactgtgttttatgtatgccttggccaccctgggtaacctgaccattgtcctcatcattcgtgtggagaggcgactgcatgagcccatgtacctcttcctggccatgctttccactattgacctagtcctctcctctatcaccatgcccaagatggccagtcttttcctgatgggcatccaggagatcgagttcaacatttgcctggcccagatgttccttatccatgctctgtcagccgtggagtcagctgtcctgctggccatggcttttgaccgctttgtggccatttgccacccattgcgccatgcttctgtgctgacagggtgtactgtggccaagattggactatctgccctgaccagggggtttgtattcttcttcccactgcccttcatcctcaagtggttgtcctactgccaaacacatactgtcacacactccttctgtctgcaccaagatattatgaagctgtcctgtactgacaccagggtcaatgtggtttatggactcttcatcatcctctcagtcatgggtgtggactctctcttcattggcttctcatatatcctcatcctgtgggctgttttggagctgtcctctcggagggcagcactcaaggctttcaacacctgcatctcccacctctgtgctgttctggtcttctatgtacccctcattgggctctcggtggtgcataggctgggtggtcccacctccctcctccatgtggttatggctaatacctacttgctgctaccacctgtagtcaacccccttgtctatggagccaagaccaaagagatctgttcaagggtcctctgtatgttctcacaaggtggcaagtga

SEQ ID NO: 83 - protein, 320 aa, Homo sapiens
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 84 - DNA, 963 bp, Homo sapiens
atgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagtggtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtga

SEQ ID NO: 85 - protein, 314 aa, Homo sapiens
MLPSNITSTHPAVFLLVGIPGLEHLHAWISIPFCFAYTLALLGNCTLLFIIQADAALHEPMYLFLAMLATIDLVLSSTTLPKMLAIFWFRDQEINFFACLVQMFFLHSFSIMESAVLLAMAFDRYVAICKPLHYTTVLTGSLITKIGMAAVARAVTLMTPLPFLLRRFHYCRGPVIAHCYCEHMAVVRLACGDTSFNNIYGIAVAMFSVVLDLLFVILSYVFILQAVLQLASQEARYKAFGTCVSHIGAILSTYTPVVISSVMHRVARHAAPRVHILLAIFYLLFPPMVNPIIYGVKTKQIREYVLSLFQRKNM

SEQ ID NO: 86 - DNA, 1400 bp, Homo sapiens
tggaaacaagaggtaatctttgcaggtgggatagcacaggttgaactctaatcatatatactgtagaaggtatatatagaaggtgaagaagccctgtaaaaattgacaaggagatttccaggagccatgcttccctctaatatcacctcaacacatccagctgtctttttgttggtaggaattcctggtttggaacacctgcatgcctggatctccatccccttctgctttgcttatactctggccctgctaggcaactgtacccttctcttcattatccaggctgatgcagccctccatgaacccatgtacctctttctggccatgttggcaaccattgacttggttctttcttctacaacgctgcccaaaatgcttgccatattctggttcagggatcaggagatcaacttctttgcctgtctggtccagatgttcttccttcactccttctccatcatggagtcagcagtgctgctggccatggcctttgaccgctatgtggccatctgcaagccattgcactacacgacggtcctgactgggtccctcatcaccaagattggcatggctgctgtggcccgggctgtgacactaatgactccactccccttcctgctcagacgcttccactactgccgaggcccagtgattgcccattgctactgtgaacacatggctgtggtaaggctggcgtgtggggacactagcttcaacaatatctatggcattgctgtggccatgtttagtgtggtgttggacctgctctttgttatcctgtcttatgtcttcatccttcaggcagttctccagcttgcctctcaggaggcccgctacaaagcatttgggacatgtgtgtctcacataggtgccatcctgtccacctacactccagtagtcatctcttcagtcatgcaccgtgtagcccgccatgctgcccctcgtgtccacatactccttgctattttctatctccttttcccacccatggtcaatcctatcatatatggagtcaagaccaagcagattcgtgagtatgtgctcagtctattccagagaaagaacatgtagatggatagttctctttttttatcccacttgccaagtaatgagaatgctggattggggttgaggggaaaaatctaaataggaaaattgcagagtatctttgacaattctctagtatgataaggaaaatgaggtttcattcctcacagatctacgagtcaggtcaaaccaggagtgcacctatagtctggtctgatagtagaggtttgaccttcccattgtcatagactcatcacatggctaaggaagacaaacctctcaaagtggtattgtaatctgggtgaaagacagtaggacctttattggctgagattggcccaaacagctgagtc

SEQ ID NO: 87 - protein, 384 aa, Homo sapiens
  MOD_RES (68): Variable amino acid
MNIKHCGWHMIHTWLNIREDDDSDFKNFIGQIQGLSGNPHSTTSRMYFLCFCTSLLGFKVHWVSRLIXKLYMASPNNDSTAPVSEFLLICFPNFQSWQHWLSLPLSLLFLLAMGANTTLLITIQLEASLHQPLYYLLSLLSLLDIVLCLTVIPKVLAIFWFDLRSISFPACFLQMFIMNSFLTMESCTFMVMAYDRYVAICHPLRYPSIITDQFVARAVVFVIARNAFVSLPVPMLSARLRYCAGNIIKNCICSNLSVSKLSCDDITFNQLYQFVAGWTLLGSDLILIVISYSFILKVVLRIKAEGAVAKALSTCGSHFILILFFSTVLLVLVITNLARKRIPPDVPILLNILHHLIPPALNPIVYGVRTKEIKQGIQNLLKRL

SEQ ID NO: 88 - DNA, 1155 bp, Homo sapiens
  modified_base (203): A, T, C or G
atgaatataaaacattgtggctggcatatgatacatacttggttaaatataagggaggatgatgacagtgattttaaaaactttattggacagatacagggcctcagtggaaacccacactctactacgtctagaatgtactttttatgtttctgtacttctctactaggttttaaggtacactgggtctccagattgatcangaaactttacatggcatctcccaacaatgactccactgccccagtctctgaattcctcctcatctgcttccccaacttccagagctggcagcactggttgtctctgcccctcagccttctcttcctcctggccatgggagctaacaccaccctcctgatcaccatccagctggaggcctctctgcaccagcccctgtactacctgctcagcctcctctccctgctggacatcgtgctctgcctcaccgtcatccccaaggtcctggccatcttctggtttgacctcaggtcgatcagcttcccagcctgcttcctccagatgttcatcatgaacagttttttgaccatggagtcctgcacgttcatggtcatggcctatgaccgttatgtggccatctgccatccattgagatacccgtctatcatcactgaccagtttgtggctagggccgtggtctttgttatagcccggaatgcctttgtttctcttcctgttcccatgctttctgccaggctcagatactgtgcaggaaacataatcaagaactgcatctgcagtaacctgtctgtgtccaaactctcttgtgatgacatcactttcaatcagctctaccagtttgtggcaggctggactctgttgggctctgatcttatccttattgttatctcctattcttttatattgaaagttgtgcttaggatcaaggccgagggtgctgtggccaaggccttgagcacgtgtggttcccacttcatcctcatcctcttcttcagcacagtcctgctggttctggtcatcactaacctggccaggaagagaattcctccagatgtccccatcctgctcaacatcctgcaccacctcattcccccagctctgaaccccattgtttatggtgtgagaaccaaggagatcaagcagggaatccaaaacctgctgaagaggttgtaa

SEQ ID NO: 89 - protein, 314 aa, Homo sapiens
MSASNITLTHPTAFLLVGIPGLEHLHIWISIPFCLAYTLALLGNCTLLLIIQADAALHEPMYLFLAMLAAIDLVLSSSALPKMLAIFWFRDREINFFACLAQMFFLHSFSIMESAVLLAMAFDRYVAICKPLHYTKVLTGSLITKIGMAAVARAVTLMTPLPFLLRCFHYCRGPVIAHCYCEHMAVVRLACGDTSFNNIYGIAVAMFIVVLDLLLVILSYIFILQAVLLLASQEARYKAFGTCVSHIGAILAFYTTVVISSVMHRVARHAAPHVHILLANFYLLFPPMVNPIIYGVKTKQIRESILGVFPRKDM

SEQ ID NO: 90 - DNA, 945 bp, Homo sapiens
atgtcagcctccaatatcaccttaacacatccaactgccttcttgttggtggggattccaggcctggaacacctgcacatctggatctccatccctttctgcttagcatatacactggccctgcttggaaactgcactctccttctcatcatccaggctgatgcagccctccatgaacccatgtacctctttctggccatgttggcagccatcgacctggtcctttcctcctcagcactgcccaaaatgcttgccatattctggttcagggatcgggagataaacttctttgcctgtctggcccagatgttcttccttcactccttctccatcatggagtcagcagtgctgctggccatggcctttgaccgctatgtggctatctgcaagccactgcactacaccaaggtcctgactgggtccctcatcaccaagattggcatggctgctgtggcccgggctgtgacactaatgactccactccccttcctgctgagatgtttccactactgccgaggcccagtgatcgctcactgctactgtgaacacatggctgtggtgaggctggcgtgtggggacactagcttcaacaatatctatggcatcgctgtggccatgtttattgtggtgttggacctgctccttgttatcctgtcttatatctttattcttcaggcagttctactgcttgcctctcaggaggcccgctacaaggcatttgggacatgtgtctctcatataggtgccatcttagccttctacacaactgtggtcatctcttcagtcatgcaccgtgtagcccgccatgctgcccctcatgtccacatcctccttgccaatttctatctgctcttcccacccatggtcaatcccataatctatggtgtcaagaccaagcaaatccgtgagagcatcttgggagtattcccaagaaaggatatgtag

SEQ ID NO: 91 - protein, 318 aa, Homo sapiens
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 92 - DNA, 957 bp, Homo sapiens
atgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagtttgatgcttgtctgctacagatgtttgccatccactccttatctggcatggaatccacagtgctgctggccatggcttttgaccgctatgtggccatctgtcacccactgcgccatgccacagtacttacgttgcctcgtgtcaccaaaattggtgtggctgctgtggtgcggggggctgcactgatggcaccccttcctgtcttcatcaagcagctgcccttctgccgctccaatatcctttcccattcctactgcctacaccaagatgtcatgaagctggcctgtgatgatatccgggtcaatgtcgtctatggccttatcgtcatcatctccgccattggcctggactcacttctcatctccttctcatatctgcttattcttaagactgtgttgggcttgacacgtgaagcccaggccaaggcatttggcacttgcgtctctcatgtgtgtgctgtgttcatattctatgtacctttcattggattgtccatggtgcatcgctttagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagccctag

SEQ ID NO: 93 - protein, 317 aa, Homo sapiens
MLTFHNVCSVPSSFWLTGIPGLESLHVWLSIPFGSMYLVAVVGNVTILAVVKIERSLHQPMYFFLCMLAAIDLVLSTSTIPKLLGIFWFGACDIGLDACLGQMFLIHCFATVESGIFLAMAFDRYVAICNPLRHSMVLTYTVVGRLGLVSLLRGVLYIGPLPLMIRLRLPLYKTHVISHSYCEHMAVVALTCGDSRVNNVYGLSIGFLVLILDSVAIAASYVMIFRAVMGLATPEARLKTLGTCASHLCAILIFYVPIAVSSLIHRFGQCVPPPVHTLLANFYLLIPPILNPIVYAVRTKQIRESLLQIPRIEMKIR

SEQ ID NO: 94 - DNA, 954 bp, Homo sapiens
atgctcacttttcataatgtctgctcagtacccagctccttctggctcactggcatcccagggctggagtccctacacgtctggctctccatcccctttggctccatgtacctggtggctgtggtggggaatgtgaccatcctggctgtggtaaagatagaacgcagcctgcaccagcccatgtactttttcttgtgcatgttggctgccattgacctggttctgtctacttccactatacccaaacttctgggaatcttctggttcggtgcttgtgacattggcctggacgcctgcttgggccaaatgttccttatccactgctttgccactgttgagtcaggcatcttccttgccatggcttttgatcgctacgtggccatctgcaacccactacgtcatagcatggtgctcacttatacagtggtgggtcgtttggggcttgtttctctcctccggggtgttctctacattggacctctgcctctgatgatccgcctgcggctgcccctttataaaacccatgttatctcccactcctactgtgagcacatggctgtagttgccttgacatgtggcgacagcagggtcaataatgtctatgggctgagcatcggctttctggtgttgatcctggactcagtggctattgctgcatcctatgtgatgattttcagggccgtgatggggttagccactcctgaggctaggcttaaaaccctggggacatgcgcttctcacctctgtgccatcctgatcttttatgttcccattgctgtttcttccctgattcaccgatttggtcagtgtgtgcctcctccagtccacactctgctggccaacttctatctcctcattcctccaatcctcaatcccattgtctatgctgttcgcaccaagcagatccgagagagccttctccaaataccaaggatagaaatgaagattagatga

SEQ ID NO: 95 - protein, 319 aa, Homo sapiens
MNLDSFFSFLLKSLIMALSNSSWRLPQPSFFLVGIPGLEESQHWIALPLGILYLLALVGNVTILFIIWMDPSLHQSMYLFLSMLAAIDLVVASSTAPKALAVLLVRAQEIGYTVCLIQMFFTHAFSSMESGVLVAMALDRYVAICHPLHHSTILHPGVIGHIGMVVLVRGLLLLIPFLILLRKLIFCQATIIGHAYCEHMAVVKLACSETTVNRAYGLTVALLVVGLDVLAIGVSYAHILQAVLKVPGNEARLKAFSTCGSHVCVILVFYIPGMFSFLTHRFGHHVPHHVHVLLAILYRLVPPALNPLVYRVKTQKIHQ

SEQ ID NO: 96 - DNA, 960 bp, Homo sapiens
atgaatttggattcttttttctctttcctcctcaagtcattgataatggcacttagcaattccagctggaggctaccccagccttcttttttcctggtaggaattccgggtttagaggaaagccagcactggatcgcactgcccctgggcatcctttacctccttgctctagtgggcaatgttaccattctcttcatcatctggatggacccatccttgcaccaatctatgtacctcttcctgtccatgctagctgccatcgacctggttgtggcctcctccactgcacccaaagcccttgcagtgctcctggttcgtgcccaagagattggttacactgtctgcctgatccagatgttcttcacccatgcattctcctccatggagtcaggggtacttgtggccatggctctggatcgctatgtagccatttgtcaccccttgcaccattccacaatcctgcatccaggggtcatagggcacatcggaatggtggtgctggtgcggggattactactcctcatccccttcctcattctgttgcgaaaacttatcttctgccaagccaccatcataggccatgcctattgtgaacatatggctgttgtgaaacttgcctgctcagaaaccacagtcaatcgagcttatgggctgactgtggccttgcttgtggttgggctggatgtcctggccattggtgtttcctatgcccacattctccaggcagtgctgaaggtaccaggaaatgaggcccgacttaaggcctttagcacatgtggctctcatgtttgtgtcatcctggtcttctatatcccgggaatgttctccttcctcactcaccgctttggtcatcatgtaccccatcacgtccatgttcttctggccatactgtatcgccttgtgccacctgcactcaatcctcttgtctatagggtgaagacccagaagatccaccagtga

SEQ ID NO: 97 - protein, 350 aa, Homo sapiens
MCQQILRDCILLIHHLCINRKKVSLVMLGPAYNHTMETPASFLLVGIPGLQSSHLWLAISLSAMYIIALLGNTIIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAITIRAIIAITPLSWMVSHLPFCGSNVVVHSYCEHIALARLACADPVPSSLYSLIGSSLMVGSDVAFIAASYILILKAVFGLSSKTAQLKALSTCGSHVGVMALYYLPGMASIYAAWLGQDVVPLHTQVLLADLYVIIPATLNPIIYGMRTKQLRERIWSYLMHVLFDHSNLGS

SEQ ID NO: 98 - DNA, 1053 bp, Homo sapiens
atgtgtcaacaaatcttacgggattgcattcttctcatacatcatttgtgcattaacaggaaaaaagtctcacttgtgatgctgggtccagcttataaccacacaatggaaacccctgcctccttcctccttgtgggtatcccaggactgcaatcttcacatctttggctggctatctcactgagtgccatgtacatcatagccctgttaggaaacaccatcatcgtgactgcaatctggatggattccactcggcatgagcccatgtattgctttctgtgtgttctggctgctgtggacattgttatggcctcctcggtggtacccaagatggtgagcatcttctgctcaggagacagctcaatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccatcaccatcagagctatcatagccataactccactgagttggatggtgagtcatctacctttctgtggctccaatgtggttgtccactcctactgtgagcacatagctttggccaggttagcatgtgctgaccccgtgcccagcagtctctacagtctgattggttcctctcttatggtgggctctgatgtggccttcattgctgcctcctatatcttaattctcaaggcagtatttggtctctcctcaaagactgctcagttgaaagcattaagcacatgtggctcccatgtgggggttatggctttgtactatctacctgggatggcatccatctatgcggcctggttggggcaggatgtagtgcccttgcacacccaagtcctgctagctgacctgtacgtgatcatcccagccaccttaaatcccatcatctatggcatgaggaccaaacaactgcgggagagaatatggagttatctgatgcatgtcctctttgaccattccaacctgggttcatga

SEQ ID NO: 99 - protein, 324 aa, Homo sapiens
MLGPAYNHTMETPASFLLVGIPGLQSSHLWLAISLSAMYITALLGNTLIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAVTIRAVTFMTPLSWMMNHLPFCGSNVVVHSYCKHIALARLACADPVPSSLYSLIGSSLMVGSDVAFIAASYILILRAVFDLSSKTAQLKALSTCGSHVGVMALYYLPGMASIYAAWLGQDIVPLHTQVLLADLYVIIPATLNPIIYGMRTKQLLEGIWSYLMHFLFDHSNLGS

SEQ ID NO: 100 - DNA, 975 bp, Homo sapiens
atgctgggtccagcttacaaccacacaatggaaacccctgcctccttcctccttgtgggtatcccaggactgcaatcttcacatctttggctggctatctcactgagtgccatgtacatcacagccctgttaggaaacaccctcatcgtgactgcaatctggatggattccactcggcatgagcccatgtattgctttctgtgtgttctggctgctgtggacattgttatggcctcctccgtggtacccaagatggtgagcatcttctgctcgggagacagctccatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccgtcaccatcagagctgtcacattcatgactccactgagttggatgatgaatcatctacctttctgtggctccaatgtggttgtccactcctactgtaagcacatagctttggccaggttagcatgtgctgaccccgtgcccagcagtctctacagtctgattggttcctctcttatggtgggctctgatgtggccttcattgctgcctcctatatcttaattctcagggcagtatttgatctctcctcaaagactgctcagttgaaagcattaagcacatgtggctcccatgtgggggttatggctttgtactatctacctgggatggcatccatctatgcggcctggttggggcaggatatagtgcccttgcacacccaagtgctgctagctgacctgtacgtgatcatcccagccactttaaatcccatcatctatggcatgaggaccaaacaattgctggagggaatatggagttatctgatgcacttcctctttgaccactccaacctgggttcatga

SEQ ID NO: 101 - protein, 318 aa, Homo sapiens
MSDSNLSDNHLPDTFFLTGIPGLEAAHFWIAIPFCAMYLVALVGNAALILVIAMDNALHAPMYLFLCLLSLTDLALSSTTVPKMLAILWLHAGEISFGGCLAQMFCVHSIYALESSILLAMAFDRYVAICNPLRYTTILNHAVIGRIGFVGLFRSVAIVSPFIFLLRRLPYCGHRVMTHTYCEHMGIARLACANITVNIVYGLTVALLAMGLDSILIAISYGFILHAVFHLPSHDAQHKALSTCGSHIGIILVFYIPAFFSFLTHRFGHHEVPKHVHIFLANLYVLVPPVLNPILYGARTKEIRSRLLKLLHLGKTSI

SEQ ID NO: 102 - DNA, 957 bp, Homo sapiens
atgtcagattccaacctcagtgataaccatcttccagacaccttcttcttaacagggatcccagggctggaggctgcccacttctggattgccatccctttctgtgccatgtatcttgtagcactggttggaaatgctgccctcatcctggtcattgccatggacaatgctcttcatgcacctatgtacctcttcctctgccttctctcactcacagacctggctctcagttctaccactgtgcccaagatgctggccattttgtggctccatgctggtgagatttcctttggtggatgcctggcccagatgttttgtgtccattctatctatgctctggagtcctcgattctacttgccatggcctttgataggtatgtggctatctgtaacccattaaggtatacaaccattctcaaccatgctgtcataggcagaattggctttgttgggctattccgtagtgtggctattgtctcccccttcatcttcttgctgaggcgactcccctactgtggtcaccgtgtcatgacacacacatactgtgagcatatgggcatcgcccgactggcctgtgccaacatcactgtcaatattgtctatgggctaactgtggctctgctggccatgggactggattccattctcattgccatttcctatggctttatcctccatgcagtctttcaccttccatctcatgatgcccagcacaaagctctgagtacctgtggctcccacattggcatcatcctggttttctacatccctgccttcttctccttcctcacccaccgctttggtcaccacgaagtccccaagcatgtgcacatctttctggctaatctctatgtgctggtgcctcctgtactcaatcctattctctatggagctagaaccaaggagattcggagtcgacttctaaaactgcttcacctggggaagacttcaatatga

SEQ ID NO: 103 - protein, 326 aa, Homo sapiens
MSFQVTYMFYLHWTMEKSNNSTLFILLGFSQNKNIEVLCFVLFLFCYIAIWMGNLLIMISITCTQLIHQPMYFFLNYLSLSDLCYTSTVTPKLMVDLLAERKTISYNNCMIQLFTTHFFGGIEIFILTGMAYDRYVAICKPLHYTIIMSRQKCNTIIIVCCTGGFIHSASQFLLTIFVPFCGPNEIDHYFCDVYPLLKLACSNIHMIGLLVIANSGLIALVTFVVLLLSYVFILYTIRAYSAERRSKALATCSSHVIVVVLFFAPALFIYIRPVTTFSEDKVFALFYTIIAPMFNPLIYTLRNTEMKNAMRKVWCCQILLKRNQLF

SEQ ID NO: 104 - DNA, 981 bp, Homo sapiens
atgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgctcctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctga

SEQ ID NO: 105 - protein, 370 aa, Homo sapiens
MFSMTTEALNNFALGCTNLLMTMIPQIDLKQIFLCPNCRLYMIPVGAFIFSLGNMQNQSFVTEFVLLGLSQNPNVQEIVFVVFLFVYIATVGGNMLIVVTILSSPALLVSPMYFFLGFLSFLDACFSSVITPKMIVDSLYVTKTISFEGCMMQLFAEHFFAGVEVIVLTAMAYDRYVAICKPLHYSSIMNRRLCGILMGVAWTGGLLHSMIQILFTFQLPFCGPNVINHFMCDLYPLLELACTDTHIFGLMVVINSGFICIINFSLLLVSYAVILLSLRTHSSEGRWKALSTCGSHIAVVILFFVPCIFVYTRPPSAFSLDKMAAIFYIILNPLLNPLIYTFRNKEVKQAMRRIWNRLMVVSDEKENIKL

SEQ ID NO: 106 - DNA, 1113 bp, Homo sapiens
atgttctcaatgacaacagaagcactcaataattttgcacttggatgtaccaacttgttaatgactatgataccacaaattgatctgaagcaaattttcctttgtcctaattgcagactatacatgatccctgttggagctttcatcttttccttgggaaacatgcaaaaccaaagctttgtaactgagtttgtcctcctgggactttcacagaatccaaatgttcaggaaatagtatttgttgtatttttgtttgtctacattgcaactgttgggggcaacatgctaattgtagtaaccattctcagcagccctgctcttctggtgtctcctatgtacttcttcttgggcttcctgtccttcctggatgcgtgcttctcatctgtcatcaccccaaagatgattgtagactccctctatgtgacaaaaaccatctcttttgaaggctgcatgatgcagctctttgctgaacacttctttgctggggtggaggtgattgtcctcacagccatggcctatgatcgttatgtggccatttgcaagcccttgcattactcttctatcatgaacaggaggctctgtggcattctgatgggggtagcctggacagggggcctcttgcattccatgatacaaattctttttactttccagcttcccttttgtggccccaatgtcatcaatcactttatgtgtgacttgtacccgttactggagcttgcctgcactgatactcacatctttggcctcatggtggtcatcaacagtgggtttatctgcatcataaacttctccttgttgcttgtctcctatgctgtcatcttgctctctctgagaacacacagttctgaagggcgctggaaagctctctccacctgtggatctcacattgctgttgtgattttgttctttgtcccatgcatatttgtatatacacgacctccatctgctttttcccttgacaaaatggcggcaatattttatatcatcttaaatcccttgctcaatcctttgatttacactttcaggaataaggaagtaaaacaggccatgaggagaatatggaacagactgatggtggtttctgatgagaaagaaaatattaaactttaa

SEQ ID NO: 107 - protein, 315 aa, Homo sapiens
MGDWNNSDAVEPIFILRGFPGLEYVHSWLSILFCLAYLVAFMGNVTILSVIWIESSLHQPMYYFISILAVNDLGMSLSTLPTMLAVLWLDAPEIQASACYAQLFFIHTFTFLESSVLLAMAFDRFVAICHPLHYPTILTNSVIGKIGLACLLRSLGVVLPTPLLLRHYHYCHGNALSHAFCLHQDVLRLSCTDARTNSIYGLCVVIATLGVDSIFILLSYVLILNTVLDIASREEQLKALNTCVSHICVVLIFFVPVIGVSMVHRFGKHLSPIVHILMADIYLLLPPVLNPIVYSVRTKQIRLGILHKFVLRRRF

SEQ ID NO: 108 - DNA, 948 bp, Homo sapiens
atgggagactggaataacagtgatgctgtggagcccatatttatcctgaggggttttcctggactggagtatgttcattcttggctctccatcctcttctgtcttgcatatttggtagcatttatgggtaatgttaccatcctgtctgtcatttggatagaatcctctctccatcagcccatgtattactttatttccatcttagcagtgaatgacctggggatgtccctgtctacacttcccaccatgcttgctgtgttatggttggatgctccagagatccaggcaagtgcttgctatgctcagctgttcttcatccacacattcacattcctggagtcctcagtgttgctggccatggcctttgaccgttttgttgctatctgccatccactgcactaccccaccatcctcaccaacagtgtaattggcaaaattggtttggcctgtttgctacgaagcttgggagttgtacttcccacacctttgctactgagacactatcactactgccatggcaatgccctctctcacgccttctgtttgcaccaggatgttctaagattatcctgtacagatgccaggaccaacagtatttatgggctttgtgtagtcattgccacactaggtgtggattcaatcttcatacttctttcttatgttctgattcttaatactgtgctggatattgcatctcgtgaagagcagctaaaggcactcaacacatgtgtatcccatatctgtgtggtgcttatcttctttgtgccagttattggggtgtcaatggtccatcgctttgggaagcatctgtctcccatagtccacatcctcatggcagacatctaccttcttcttcccccagtccttaaccctattgtctatagtgtcagaacaaagcagattcgtctaggaattctccacaagtttgtcctaaggaggaggttttaa

SEQ ID NO: 109 - protein, 325 aa, Homo sapiens
MFLPNDTQFHPSSFLLLGIPGLETLHIWIGFPFCAVYMIALIGNFTILLVIKTDSSLHQPMFYFLAMLATTDVGLSTATIPKMLGIFWINLRGIIFEACLTQMFFIHNFTLMESAVLVAMAYDSYVAICNPLQYSAILTNKVVSVIGLGVFVRALIFVIPSILLILRLPFCGNHVIPHTYCEHMGLAHLSCASIKINIIYGLCAICNLVFDITVIALSYVHILCAVFRLPTHEPRLKSLSTCGSHVCVILAFYTPALFSFMTHCFGRNVPRYIHILLANLYVVVPPMLNPVIYGVRTKQIYKCVKKILLQEQGMEKEEYLIHTRF

SEQ ID NO: 110 - DNA, 978 bp, Homo sapiens
atgttccttcccaatgacacccagtttcacccctcctccttcctgttgctggggatcccaggactagaaacacttcacatctggatcggctttcccttctgtgctgtgtacatgatcgcactcatagggaacttcactattctacttgtgatcaagactgacagcagcctacaccagcccatgttctacttcctggccatgttggccaccactgatgtgggtctctcaacagctaccatccctaagatgcttggaatcttctggatcaacctcagagggatcatctttgaagcctgcctcacccagatgttttttatccacaacttcacacttatggagtcagcagtccttgtggcaatggcttatgacagctatgtggccatctgcaatccactccaatatagcgccatcctcaccaacaaggttgtttctgtgattggtcttggtgtgtttgtgagggctttaattttcgtcattccctctatacttcttatattgcggttgcccttctgtgggaatcatgtaattccccacacctactgtgagcacatgggtcttgctcatctatcttgtgccagcatcaaaatcaatattatttatggtttatgtgccatttgtaatctggtgtttgacatcacagtcattgccctctcttatgtgcatattctttgtgctgttttccgtcttcctactcatgagccccgactcaagtccctcagcacatgtggttcacatgtgtgtgtaatccttgccttctatacaccagccctcttttcctttatgactcattgctttggccgaaatgtgccccgctatatccatatactcctagccaatctctatgttgtggtgccaccaatgctcaatcctgtcatatatggagtcagaaccaagcagatctataaatgtgtaaagaaaatattattgcaggaacaaggaatggaaaaggaagagtacctaatacatacgaggttctga

SEQ ID NO: 111 - protein, 313 aa, Homo sapiens
MSIINTSYVEITTFFLVGMPGLEYAHIWISIPICSMYLIAILGNGTILFIIKTEPSLHGPMYYFLSMLAMSDLGLSLSSLPTVLSIFLFNAPETSSSACFAQEFFIHGFSVLESSVLLIMSFDRFLAIHNPLRYTSILTTVRVAQIGIVFSFKSMLLVLPFPFTLRSLRYCKKNQLSHSYCLHQDVMKLACSDNRIDVIYGFFGALCLMVDFILIAVSYTLILKTVPGIASKKEELKALNTCVSHICAVIIFYLPIINLAVVHRFAGHVSPLINVLMANVLLLVPPLMKPIVYCVKTKQIRVRVVAKLCQWKI

SEQ ID NO: 112 - DNA, 942 bp, Homo sapiens
atgtccattatcaacacatcatatgttgaaatcaccaccttcttcttggttgggatgccagggctagaatatgcacacatctggatctctatccccatctgcagcatgtatcttattgctattctaggaaatggcaccattctttttatcatcaagacagagccctccttgcatgggcccatgtactattttctttccatgttggctatgtcagacttgggtttgtctttatcatctctgcccactgtgttaagcatcttcctgttcaatgcccctgaaacttcttctagtgcctgctttgcccaggaattcttcattcatggattctcagtactggagtcctcagtcctcctgatcatgtcatttgatagattcctagccatccacaatcctctgagatacacctcaatcctgacaactgtcagagttgcccaaatagggatagtattctcctttaagagcatgctcctggttcttcccttccctttcactttaagaagcttgagatattgcaagaaaaaccaattatcccattcctactgtctccaccaggatgtcatgaagttggcctgttctgacaacagaattgatgttatctatggcttttttggagcactctgccttatggtagactttattctcattgctgtgtcttacaccctgatcctcaagactgtaccgggaattgcatccaaaaaggaggagcttaaggctctcaatacttgtgtttcacacatctgtgcagtgatcatcttctacctgcccatcatcaacctggccgttgtccaccgctttgccgggcatgtctctcccctcattaatgttctcatggcaaatgttctcctacttgtacctccgctgatgaaaccaattgtttattgtgtaaaaactaaacagattagagtgagagttgtagcaaaattgtgtcaatggaagatttaa

SEQ ID NO: 113 - protein, 311 aa, Homo sapiens
MFYHNKSIFHPVTFFLIGIPGLEDFHMWISGPFCSVYLVALLGNATILLVIKVEQTLREPMFYFLAILSTIDLALSATSVPRMLGIFWFDAHEINYGACVAQMFLIHAFTGMEAEVLLAMAFDRYVAICAPLHYATILTSLVLVGISMCIVIRPVLLTLPMVYLIYRLPFCQAHIIAHSYCEHMGIAKLSCGNIRINGIYGLFVVSFFVLNLVLIGISYVYILRAVFRLPSHDAQLKALSTCGAHVGVICVFYIPSVFSFLTHRFGHQIPGYIHILVANLYLIIPPSLNPIIYGVRTKQIRERVLYVFTKK

SEQ ID NO: 114 - DNA, 936 bp, Homo sapiens
atgttttatcacaacaagagcatatttcacccagtcacatttttcctcattggaatcccaggtctggaagacttccacatgtggatctccgggcctttctgctctgtttaccttgtggctttgctgggcaatgccaccattctgctagtcatcaaggtagaacagactctccgggagcccatgttctacttcctggccattctttccactattgatttggccctttctgcaacctctgtgcctcgcatgctgggtatcttctggtttgatgctcacgagattaactatggagcttgtgtggcccagatgtttctgatccatgccttcactggcatggaggctgaggtcttactggctatggcttttgaccgttatgtggccatctgtgctccactacattacgcaaccatcttgacatccctagtgttggtgggcattagcatgtgcattgtaattcgtcccgttttacttacacttcccatggtctatcttatctaccgcctacccttttgtcaggctcacataatagcccattcctactgtgagcacatgggcattgcaaaattgtcctgtggaaacattcgtatcaatggtatctatgggctttttgtagtttctttctttgttctgaacctggtgctcattggcatctcgtatgtttacattctccgtgctgtcttccgcctcccatcacatgatgctcagctaaaagccctaagcacgtgtggcgctcatgttggagtcatctgtgttttctatatcccttcagtcttctctttccttactcatcgatttggacaccaaataccaggttacattcacattcttgttgccaatctctatttgattatcccaccctctctcaaccccatcatttatggggtgaggaccaaacagattcgagagcgagtgctctatgtttttactaaaaaataa

SEQ ID NO: 115 - protein, 313 aa, Homo sapiens
MSIINTSYVEITTFFLVGMPGLEYAHIWISIPICSMYLIAILGNGTILFIIKTEPSLHEPMYYFLSMLAMSDLGLSLSSLPTVLSIFLFNAPEISSNACFAQEFFIHGFSVLESSVLLIMSFDRFLAIHNPLRYTSILTTVRVAQIGIVFSFKSMLLVLPFPFTLRNLRYCKKNQLSHSYCLHQDVMKLACSDNRIDVIYGFFGALCLMVDFILIAVSYTLILKTVLGIASKKEQLKALNTCVSHICAVIIFYLPIINLAVVHRFARHVSPLINVLMANVLLLVPPLTNPIVYCVKTKQIRVRVVAKLCQRKI

SEQ ID NO: 116 - DNA, 942 bp, Homo sapiens
atgtccattatcaacacatcatatgttgaaatcaccaccttcttcttggttgggatgccagggctagaatatgcacacatctggatctctatccccatctgcagcatgtatcttattgctattctaggaaatggcaccattctttttatcatcaagacagagccctccttgcatgagcccatgtactattttctttccatgttggctatgtcagacttgggtttgtctttatcatctctgcccactgtgttaagcatcttcctgttcaatgctcctgaaatttcatccaatgcctgctttgcccaggaattcttcattcatggattctcagtactggagtcctcagtcctcctgatcatgtcatttgatagattcctagccatccacaaccctctgagatacacctcaatcctgacaactgtcagagttgcccaaatagggatagtattctcctttaagagcatgctcctggttcttcccttccctttcactttaagaaacttgagatattgcaagaaaaaccaattatcccattcctactgtctccaccaggatgtcatgaagttggcctgttctgacaacagaattgatgttatctatggcttttttggagcactctgccttatggtagactttattctcattgctgtgtcttacaccctgatcctcaagactgtactgggaattgcatccaaaaaggagcagcttaaggctctcaatacttgtgtttcacacatctgtgcagtgatcatcttctacctgcccatcatcaacctggccgttgtccaccgctttgcccggcatgtctctcccctcattaatgttctcatggcaaatgttctcctacttgtacctccactgacgaacccaattgtttattgtgtaaaaactaaacagattagagtgagagttgtagcaaaattgtgtcaacggaagatttaa

SEQ ID NO: 117 - protein, 321 aa, Homo sapiens
MTILLNSSLQRATFFLTGFQGLEGLHGWISIPFCFIYLTVILGNLTILHVICTDATLHGPMYYFLGMLAVTDLGLCLSTLPTVLGIFWFDTREIGIPACFTQLFFIHTLSSMESSVLLSMSIDRSVAVCNPLHDSTVLTPACIVKMGLSSVLRSALLILPLPFLLKRFQYCHSHVLAHAYCLHLEIMKLACSSIIVNHIYGLFVVACTVGVDSLLIFLSYALILRTVLSIASHQERLRALNTCVSHICAVLLFYIPMIGLSLVHRFGEHLPRVVHLFMSYVYLLVPPLMNPIIYSIKTKQIRQRIIKKFQFIKSLRCFWKD

SEQ ID NO: 118 - DNA, 966 bp, Homo sapiens
atgacaattcttcttaatagcagcctccaaagagccactttcttcctgacgggcttccaaggtctagaaggtctccatggctggatctctattcccttctgcttcatctacctgacagttatcttggggaacctcaccattctccacgtcatttgtactgatgccactctccatggacccatgtactatttcttgggcatgctagctgtcacagacttaggcctttgcctttccacactgcccactgtgctgggcattttctggtttgataccagagagattggcatccctgcctgtttcactcagctcttcttcatccacaccttgtcttcaatggagtcatcagttctgttatccatgtccattgaccgctccgtggccgtctgcaacccactgcatgactccaccgtcctgacacctgcatgtattgtcaagatggggctaagctcagtgcttagaagtgctctcctcatcctccccttgccattcctcctgaagcgcttccaatactgccactcccatgtgctggctcatgcttattgtcttcacctggagatcatgaagctggcctgctctagcatcattgtcaatcacatctatgggctctttgttgtggcctgcaccgtgggtgtggactccctgctcatctttctctcatacgccctcatccttcgcaccgtgctcagcattgcctcccaccaggagcgactccgagccctcaacacctgtgtctctcatatctgtgctgtactgctcttctacatccccatgattggcttgtctcttgtgcatcgctttggtgaacatctgccccgcgttgtacacctcttcatgtcctatgtgtatctgctggtaccaccccttatgaaccccatcatctacagcatcaagaccaagcaaattcgccagcgcatcattaagaagtttcagtttataaagtcacttaggtgtttttggaaggattaa

SEQ ID NO: 119 - protein, 317 aa, Homo sapiens
MAGRMSTSNHTQFHPSSFLLLGIPGLEDVHIWIGVPFFFVYLVALLGNTALLFVIQTEQSLHEPMYYFLAMLDSIDLGLSTATIPKMLGIFWFNTKEISFGGCLSHMFFIHFFTAMESIVLVAMAFDRYIAICKPLRYTMILTSKIISLIAGIAVLRSLYMVVPLVFLLLRLPFCGHRIIPHTYCEHMGIARLACASIKVNIRFGLGNISLLLLDVILIILSYVRILYAVFCLPSWEARLKALNTCGSHIGVILAFFTPAFFSFLTHRFGHNIPQYIHIILANLYVVVPPALNPVIYGVRTKQIRERVLRIFLKTNH

SEQ ID NO: 120 - DNA, 954 bp, Homo sapiens
atggcaggaagaatgtctacgtctaatcacacccagttccatccttcttcattcctactgctgggtatcccagggctagaagatgtgcacatttggattggagtcccttttttctttgtgtatcttgttgcactcctgggaaacactgctctcttgtttgtgatccagactgagcagagtctccatgagcctatgtactacttcctggccatgttggattccattgacctgggcttgtctacagccaccatccccaaaatgttgggcatcttctggttcaataccaaagaaatatcttttggaggctgcctttctcacatgttcttcatccatttcttcactgctatggagagcattgtgttggtggccatggcctttgaccgctacattgccatttgcaaacctcttcggtacaccatgatcctcaccagcaaaatcatcagcctcattgcaggcattgctgtcctgaggagcctgtacatggttgttccactggtgtttctccttctgaggctgcccttctgtgggcatcgtatcatccctcatacttattgtgagcacatgggcattgcccgtctggcctgtgccagcatcaaagtcaacattaggtttggccttggcaacatatctctcttgttactggatgttatccttattattctctcctatgtcaggatcctgtatgctgtcttctgcctgccctcctgggaagctcgactcaaagctctcaacacctgtggttctcatattggtgttatcttagccttttttacaccagcatttttttcattcttgacacatcgttttggccataatatcccacagtatatacatattatattagccaacctgtatgtggttgtcccaccagccctcaatcctgtaatctatggagtcaggacaaagcagattcgagagagagtgctgaggatttttctcaagaccaatcactaa

SEQ ID NO: 121 - protein, 320 aa, Homo sapiens
MSFLNGTSLTPASFILNGIPGLEDVHLWISFPLCTMYSIAITGNFGLMYLIYCDEALHRPMYVFLALLSFTDVLMCTSTLPNTLFILWFNLKEIDFKACLAQMFFVHTFTGMESGVLMLMALDHCVAICFPLRYATILTNSVIAKAGFLTFLRGVMLVIPSTFLTKRLPYCKGNVIPHTYCDHMSVAKISCGNVRVNAIYGLIVALLIGGFDILCITISYTMILQAVVSLSSADARQKAFSTCTAHFCAIVLTYVPAFFTFFTHHFGGHTIPLHIHIIMANLYLLMPPTMNPIVYGVKTRQVRESVIRFFLKGKDNSHNF

SEQ ID NO: 122 - DNA, 963 bp, Homo sapiens
atgtcatttctaaatggcaccagcctaactccagcttcattcatcctaaatggcatccctggtttggaagatgtgcatttgtggatctccttcccactgtgtaccatgtacagcattgctattacagggaacttcggccttatgtacctcatctactgtgatgaggccttacacagacctatgtatgtcttccttgcccttctttccttcacagatgtgctcatgtgcaccagcacccttcccaacactctcttcatattgtggtttaatctcaaggagattgattttaaagcctgcctcgcccagatgttctttgtgcacaccttcacagggatggagtctggggtgctcatgctcatggccctggaccactgtgtggccatctgcttccctctgcgttatgccaccatcctcactaattcagtcattgctaaagctgggttcctcacttttcttaggggtgtgatgcttgttatcccttccactttcctcaccaagcgccttccatactgcaagggcaacgtcataccccacacctactgtgaccacatgtctgtggccaagatatcttgtggtaatgtcagggttaacgccatctatggtttgatagttgccctgctgattgggggctttgatatcctgtgcattacaatctcctacactatgattcttcaagcagttgtgagtctatcatcagcagatgctcgacagaaggccttcagcacctgcactgcccacttctgtgccatagtcctcacctatgttccagccttctttaccttctttacacaccattttgggggacacaccattcctctacacatacatattattatggctaatctctacctactaatgcctcccacaatgaaccctattgtgtatggggtgaaaaccaggcaggtacgagaaagtgtcattaggttctttcttaagggaaaggacaattctcataacttttaa

SEQ ID NO: 123 - protein, 321 aa, Homo sapiens
MSGDNSSSLTPGFFILNGVPGLEATHIWISLPFCFMYIIAVVGNCGLICLISHEEALHRPMYYFLALLSFTDVTLCTTMVPNMLCIFWFNLKEIDFNACLAQMFFVHMLTGMESGVLMLMALDRYVAICYPLRYATILTNPVIAKAGLATFLRNVMLIIPFTLLTKRLPYCRGNFIPHTYCDHMSVAKVSCGNFKVNAIYGLMVALLIGVFDICCISVSYTMILQAVMSLSSADARHKAFSTCTSHMCSIVITYVAAFFTFFTHRFVGHNIPNHIHIIVANLYLLLPPTMNPIVYGVKTKQIQEGVIKFLLGDKVSFTYDK

SEQ ID NO: 124 - DNA, 966 bp, Homo sapiens
atgtctggggacaacagctccagcctgaccccaggattctttatcttgaatggcgttcctgggctggaagccacacacatctggatctccctgccattctgctttatgtacatcattgctgtcgtggggaactgtgggctcatctgcctcatcagccatgaggaggccctgcaccggcccatgtactacttcctggccctgctctccttcactgatgtcaccttgtgcaccaccatggtacctaatatgctgtgcatattctggttcaacctcaaggagattgactttaacgcctgcctggcccagatgttttttgtccatatgctgacagggatggagtctggggtgctcatgctcatggccctggaccgctatgtggccatctgctaccccttacgctatgccaccatccttaccaaccctgtcatcgccaaggctggtcttgccaccttcttgaggaatgtgatgctcatcatcccattcactctcctcaccaagcgcctgccctattgccgggggaacttcatcccccacacctactgtgaccatatgtctgtggccaaggtatcctgtggcaatttcaaggtcaatgctatttatggtctgatggttgctctcctgattggtgtgtttgatatctgctgtatctctgtatcttacactatgattttgcaggctgttatgagcctgtcatcagcagatgctcgtcacaaagccttcagcacctgcacatctcacatgtgttccattgtgatcacctatgttgctgcttttttcacttttttcactcatcgttttgtaggacacaatatcccaaaccacatacacatcatcgtggccaacctttatctgctactgcctcctaccatgaacccaattgtttatggagtcaagaccaagcagattcaggaaggtgtaattaaatttttacttggagacaaggttagttttacctatgacaaatga

SEQ ID NO: 125 - protein, 315 aa, Homo sapiens
MTTHRNDTLSTEASDFLLNCFVRSPSWQHWLSLPLSLLFLLAVGANTTLLMTIWLEASLHQPLYYLLSLLSLLDIVLCLTVIPKVLTIFWFDLRPISFPACFLQMYIMNCFLAMESCTFMVMAYDRYVAICHPLRYPSIITDHFVVKAAMFILTRNVLMTLPIPILSAQLRYCGRNVIENCICANMSVSRLSCDDVTINHLYQFAGGWTLLGSDLILIFLSYTFILRAVLRLKAEGAVAKALSTCGSHFMLILFFSTILLVFVLTHVAKKKVSPDVPVLLNVLHHVIPAALNPIIYGVRTQEIKQGMQRLLKKGC

SEQ ID NO: 126 - DNA, 948 bp, Homo sapiens
atgacaacacaccgaaatgacaccctctccactgaagcttcagacttcctcttgaattgttttgtcagatcccccagctggcagcactggctgtccctgcccctcagcctccttttcctcttggccgtaggggccaacaccaccctcctgatgaccatctggctggaggcctctctgcaccagcccctgtactacctgctcagcctcctctccctgctggacatcgtgctctgcctcactgtcatccccaaggtcctgaccatcttctggtttgacctcaggcccatcagcttccctgcctgcttcctccagatgtacatcatgaattgtttcctagccatggagtcttgcacattcatggtcatggcctatgatcgttatgtagccatctgccacccactgagatatccatcaatcatcactgatcactttgtagtcaaggctgccatgtttattttgaccagaaatgtgcttatgactctgcccatccccatcctttcagcacaactccgttattgtggaagaaatgtcattgagaactgcatctgtgccaatatgtctgtttccagactctcctgcgatgatgtcaccatcaatcacctttaccaatttgctggaggctggactctgctaggatctgacctcatccttatcttcctctcctacaccttcattctgcgagctgtgctgagactcaaggcagagggtgccgtggcaaaggccctaagcacatgtggctcccacttcatgctcatcctcttcttcagcaccatccttctggtttttgtcctcacacatgtggctaagaagaaagtctcccctgatgtgccagtcttgctcaatgttctccaccatgtcattcctgcagcccttaaccccatcatttacggggtgagaacccaagaaattaagcagggaatgcagaggttgttgaagaaagggtgctaa

SEQ ID NO: 127 - protein, 359 aa, Homo sapiens
MSYSIYKSTVNIPLSHGVVHSFCHNMNCNFMHIFKFVLDFNMKNVTEVTLFVLKGFTDNLELQTIFFFLFLAIYLFTLMGNLGLILVVIRDSQLHKPMYYFLSMLSSVDACYSSVITPNMLVDFTTKNKVISFLGCVAQVFLACSFGTTECFLLAAMAYDRYVAIYNPLLYSVSMSPRVYMPLINASYVAGILHATIHTVATFSLSFCGANEIRRVFCDIPPLLAISYSDTHTNQLLLFYFVGSIELVTILIVLISYGLILLAILKMYSAEGRRKVFSTCGAHLTGVSIYYGTILFMYVRPSSSYASDHDMIVSIFYTIVIPLLNPVIYSLRNKDVKDSMKKMFGKNQVINKVYFHTKK

SEQ ID NO: 128 - DNA, 1080 bp, Homo sapiens
atgtcgtacagtatatacaagagcacagttaacatccccttgagtcatggtgttgttcattctttttgtcataatatgaactgtaactttatgcatatcttcaagtttgttctagatttcaacatgaagaatgtcactgaagttaccttatttgtactgaagggcttcacagacaatcttgaactgcagactatcttcttcttcctgtttctagcaatctacctcttcactctcatgggaaatttaggactgattttagtggtcattagggattcccagctccacaaacccatgtactattttctgagtatgttgtcttctgtggatgcctgctattcctcagttattaccccaaatatgttagtagattttacgacaaagaataaagtcatttcattccttggatgtgtagcacaggtgtttcttgcttgtagttttggaaccacagaatgctttctcttggctgcaatggcttatgatcgctatgtagccatctacaaccctctcctgtattcagtgagcatgtcacccagagtctacatgccactcatcaatgcttcctatgttgctggcattttacatgctactatacatacagtggctacatttagcctatccttctgtggagccaatgaaattaggcgtgtcttttgtgatatccctcctctccttgctatttcttattctgacactcacacaaaccagcttctactcttctactttgtgggctctatcgagctggtcactatcctgattgttctgatctcctatggtttgattctgttggccattctgaagatgtattctgctgaagggaggagaaaagtcttctccacatgtggagctcacctaactggagtgtcaatttattatgggacaatcctcttcatgtatgtgagaccaagttccagctatgcttcggaccatgacatgatagtgtcaatattttacaccattgtgattcccttgctgaatcccgtcatctacagtttgaggaacaaagatgtaaaagactcaatgaaaaaaatgtttgggaaaaatcaggttatcaataaagtatattttcatactaaaaaataa

SEQ ID NO: 129 - protein, 340 aa, Homo sapiens
MDSTFTGYNLYNLQVKTEMDKLSSGLDIYRNPLKNKTEVTMFILTGFTDDFELQVFLFLLFFAIYLFTLIGNLGLVVLVIEDSWLHNPMYYFLSVLSFLDACYSTVVTPKMLVNFLAKNKSISFIGCATQMLLFVTFGTTECFLLAAMAYDHYVAIYNPLLYSVSMSPRVYVPLITASYVAGILHATIHIVATFSLSFCGSNEIRHVFCDMPPLLAISCSDTHTNQLLLFYFVGSIEIVTILIVLISCDFILLSILKMHSAKGRQKAFSTCGSHLTGVTIYHGTILVSYMRPSSSYASDHDIIVSIFYTIVIPKLNPIIYSLRNKEVKKAVKKMLKLVYK

SEQ ID NO: 130 - DNA, 1023 bp, Homo sapiens
atggactccactttcacaggctataacctttataacctgcaagtaaaaactgaaatggacaagttgtcatcaggtttggatatatacaggaatccactgaagaacaagactgaagtcaccatgtttatattgacaggcttcacagatgattttgagctgcaagtcttcctatttttactattttttgcaatctatctctttaccttgataggcaatttagggctggttgtgttggtcattgaggattcctggctccacaaccccatgtattattttcttagtgttttatcattcttggatgcttgctattctacagttgtcactccaaaaatgttggtcaatttcctggcaaaaaataaatccatttcatttatcggatgtgcaacacagatgcttctttttgttacttttggaactacagaatgttttctcttggctgcaatggcttatgatcactatgtagccatctacaaccctctcctgtattcagtgagcatgtcacccagagtctatgtgccactcatcactgcttcctacgttgctggcattttacatgctactatacatatagtggctacatttagcctgtccttctgtggatccaatgaaattaggcatgtcttttgtgatatgcctcctctccttgctatttcttgttctgacactcacacaaaccagcttctactcttctactttgtgggttctattgagatagtcactatcctgattgtcctcatttcctgtgatttcattctgttgtccattctgaagatgcattctgctaagggaaggcaaaaggccttctctacatgtggctctcacctaactggagtgacaatttatcatggaacaattctcgtcagttatatgagaccaagttccagctatgcttcagaccatgacatcatagtgtcaatattttacacaattgtgattcccaagttgaatcccatcatctatagtttgaggaacaaagaagtaaaaaaggcagtgaagaaaatgttgaaattggtttacaaatga

SEQ ID NO: 131 - protein, 311 aa, Homo sapiens
MGRRNNTNVPDFILTGLSDSEEVQMALFILFLLIYLITMLGNVGMILIIRLDLQLHTPMYFFLTHLSFIDLSYSTVITPKTLANLLTSNYISFMGCFAQMFFFVFLGAAECFLLSSMAYDRYVAICSPLRYPVIMSKRLCCALVTGPYVISFINSFVNVVWMSRLHFCDSNVVRHFFCDTSPILALSCMDTYDIEIMIHILAGSTLMVSLITISASYVSILSTILKINSTSGKQKALSTCASHLLGVTIFYGTMIFTYLKPRKSYSLGRDQVASVFYTIVIPMLNPLIYSLRNKEVKNALIRVMQRRQDSR

SEQ ID NO: 132 - DNA, 936 bp, Homo sapiens
atgggtagaagaaataacacaaatgtgcctgacttcatccttacgggactgtcagattctgaagaggtccagatggccctctttatactatttctcctgatatacctaattactatgctgggcaatgtggggatgatattgataatccgcctggacctccagcttcacactcccatgtattttttccttactcacttgtcatttattgacctcagttactcaactgtcatcacacctaaaaccttagcgaacttactgacttccaactatatttccttcatgggctgctttgcccagatgttcttttttgtcttcttgggagctgctgaatgttttcttctctcatcaatggcctatgatcgctacgtagctatctgcagtcctctacgttacccagttattatgtccaaaaggctgtgttgcgctcttgtcactgggccctatgtgattagctttatcaactcctttgtcaatgtggtttggatgagcagactgcatttctgcgactcaaatgtagttcgtcactttttctgcgacacgtctccaattttagctctgtcctgcatggacacatacgacattgaaatcatgatacacattttagctggttccaccctgatggtgtcccttatcacaatatctgcatcctatgtgtccattctctctaccatcctgaaaattaattccacttcaggaaagcagaaagctttgtctacttgtgcctctcatctcttgggagtcaccatcttttatggaactatgatttttacttatttaaaaccaagaaagtcttattctttgggaagggatcaagtggcttctgttttttatactattgtgattcccatgctgaatccactcatttatagtcttagaaacaaagaagttaaaaatgctctcattagagtcatgcagagaagacaggactccaggtaa

SEQ ID NO: 133 - protein, 316 aa, Homo sapiens
MAPENFTRVTEFILTGVSSCPELQIPLFLVFLVLYGLTMAGNLGIITLTSVDSRLQTPMYFFLQHLALINLGNSTVIAPKMLINFLVKKKTTSFYECATQLGGFLFFIVSEVIMLALMACDRYVAICNPLLYMVVVSRRLCLLLVSLTYLYGFSTAIVVSSYVFSVSYCSSNIINHFYCDNVPLLALSCSDTYLPETVVFISAATNVVGSLIIVLVSYFNIVLSILKICSSEGRKKAFSTCASHMMAVTIFYGTLLFMYVQPRSNHSLDTDDKMASVFYTLVIPMLNPLIYSLRNKDVKTALQRFMTNLCYSFKTM

SEQ ID NO: 134 - DNA, 951 bp, Homo sapiens
atggctcctgaaaatttcaccagggtcactgagtttattcttacaggtgtctctagctgtccagagctccagattcccctcttcctggtctttctggtgctctatgggctgaccatggcagggaacctgggcatcatcaccctcaccagtgttgactctcgacttcaaacccccatgtactttttcctgcaacatctggctctcattaatcttggtaactctactgtcattgcccctaaaatgctgattaactttttagtaaagaagaaaactacctcattctatgaatgtgccacccaactgggagggttcttgttctttattgtatcggaggtaatcatgctggctttgatggcctgtgaccgctatgtggctatttgtaaccctctgctgtacatggtggtggtgtctcggcggctctgcctcctgctggtctccctcacatacctctatggcttttctacagctattgtggtttcatcttatgtattctctgtgtcttattgctcttctaatataatcaatcatttttactgtgataatgttcctctgttagcattatcttgctctgatacttacttaccagaaacagttgtctttatatctgcagcaacaaatgtggttggttccttgattatagttctagtatcttatttcaatattgttttgtctattttaaaaatatgttcatcagaaggaaggaaaaaagccttttctacctgtgcttcacatatgatggcagtcacaattttttatgggacattgctattcatgtatgtgcagccccgaagtaaccattcattggatactgatgataagatggcttctgtgttttacacgttggtaattcctatgctgaatcccttgatctacagcctgaggaataaggatgtgaagactgctctacagagattcatgacaaatctgtgctattcctttaaaacaatgtaa

SEQ ID NO: 135 - protein, 319 aa, Homo sapiens
MNHVVKHNHTAVTKVTEFILMGITDNPGLQAPLFGLFLIIYLVTVIGNLGMVILTYLDSKLHTPMYFFLRHLSITDLGYSTVIAPKMLVNFIVHKNTISYNWYATQLAFFEIFIISELFILSAMAYDRYVAICKPLLYVIIMAEKVLWVLVIVPYLYSTFVSLFLTIKLFKLSFCGSNIISYFYCDCIPLMSILCSDTNELELIILIFSGCNLLFSLSIVLISYMFILVAILRMNSRKGRYKAFSTCSSHLTVVIMFYGTLLFIYLQPKSSHTLAIDKMASVFYTLLIPMLNPLIYSLRNKEVKDALKRTLTNRFKIPI

SEQ ID NO: 136 - DNA, 960 bp, Homo sapiens
atgaatcatgtggtaaaacacaatcacacggcagtgaccaaggtgactgaatttattctcatggggattacagacaaccctgggctgcaggctccactgtttggactcttcctcatcatatatctggtcacagtgataggcaatctgggcatggttatcttgacctacttggactccaagctacacacccccatgtactttttccttagacatttgtcaatcactgatcttggttactccactgtcattgccccgaagatgttagtaaacttcatagtgcacaaaaacacaatttcttacaattggtatgccactcagctagcattctttgagattttcatcatctctgagctctttattctatcagcaatggcctatgatcgctacgtagccatctgtaaacctcttctgtacgtgatcatcatggcagagaaagtactttgggtgctggtaattgttccctatctctatagcacgtttgtgtcactatttctcacaattaagttatttaaactgtccttctgtggctcaaacataatcagctatttttactgtgactgtatccctctgatgtccatactctgttctgacacaaatgaattagaattaataattttgatcttctcaggctgtaatttgctcttctccctctcaattgttctcatatcctacatgtttattctagtggccattctcagaatgaactcaaggaaagggaggtacaaagccttctccacctgtagctctcatctgacagtggtgatcatgttctatgggacattgttatttatttacttgcaacccaagtccagtcatactttggctattgataaaatggcctcagtgttttataccctgttgattcctatgctgaatccgttgatctacagcctaaggaacaaagaagtaaaagatgctctaaagagaactttaaccaatcgattcaaaattcccatttaa

SEQ ID NO: 137 - protein, 312 aa, Homo sapiens
MEQHNLTTVNEFILTGITDIAELQAPLFALFLMIYVISVMGNLGMIVLTKLDSRLQTPMYFFLRHLAFMDLGYSTTVGPKMLVNFVVDKNIISYYFCATQLAFFLVFIGSELFILSAMSYDLYVAICNPLLYTVIMSRRVCQVLVAIPYLYCTFISLLVTIKIFTLSFCGYNVISHFYCDSLPLLPLLCSNTHEIELIILIFAAIDLISSLLIVLLSYLLILVAILRMNSAGRQKAFSTCGAHLTVVIVFYGTLLFMYVQPKSSHSFDTDKVASIFYTLVIPMLNPLIYSLRNKDVKYALRRTWNNLCNIFV

SEQ ID NO: 138 - DNA, 939 bp, Homo sapiens
atggaacaacacaatctaacaacggtgaatgaattcattcttacgggaatcacagatatcgctgagctgcaggcaccattatttgcattgttcctcatgatctatgtgatctcagtgatgggcaatttgggcatgattgtcctcaccaagttggactccaggttgcaaacccctatgtacttttttctcagacatctggctttcatggatcttggttattcaacaactgtgggacccaaaatgttagtaaattttgttgtggataagaatataatttcttattatttttgtgcaacacagctagctttctttcttgtgttcattggtagtgaactttttattctctcagccatgtcctacgacctctatgtggccatctgtaaccctctgctatacacagtaatcatgtcacgaagggtatgtcaggtgctggtagcaatcccttacctctattgcacattcatttctcttctagtcaccataaagatttttactttatccttctgtggctacaacgtcattagtcatttctactgtgacagtctccctttgttacctttgctttgttcaaatacacatgaaattgaattgataattctgatctttgcagctattgatttgatttcatctcttctgatagttcttttatcttacctgctcatccttgtagccattctcaggatgaattctgctggcagacaaaaggctttttctacctgtggagcccacctgacagtggtcatagtgttctatgggactttgcttttcatgtacgtgcagcccaagtccagtcattcctttgacactgataaagtggcttccatattttacaccctggttatccccatgttgaatcccttgatctatagtttacgaaacaaagatgtaaaatatgccctacgaaggacatggaataacttatgtaatatttttgtttaa

SEQ ID NO: 139 - protein, 337 aa, Homo sapiens [sequence omitted]

SEQ ID NO: 140 - DNA, 1014 bp, Homo sapiens
atggaagggaaaaatcaaaccaatatctctgaatttctcctcctgggcttctcaagttggcaacaacagcaggtgctactctttgcacttttcctgtgtctctatttaacagggctgtttggaaacttactcatcttgctggccattggctcggatcactgccttcacacacccatgtatttcttccttgccaatctgtccttggtagacctctgccttccctcagccacagtccccaagatgctactgaacatccaaacccaaacccaaaccatctcctatcccggctgcctggctcagatgtatttctgtatgatgtttgccaatatggacaattttcttctcacagtgatggcatatgaccgttacgtggccatctgtcaccctttacattactccaccattatggccctgcgcctctgtgcctctctggtagctgcaccttgggtcattgccattttgaaccctctcttgcacactcttatgatggcccatctgcacttctgctctgataatgttatccaccatttcttctgtgatatcaactctctcctccctctgtcctgttccgacaccagtcttaatcagttgagtgttctggctacggtggggctgatctttgtggtaccttcagtgtgtatcctggtatcctatatcctcattgtttctgctgtgatgaaagtcccttctgcccaaggaaaactcaaggctttctctacctgtggatctcaccttgccttggtcattcttttctatggagcaaacacaggggtctatatgagccccttatccaatcactctactgaaaaagactcagccgcatcagtcatttttatggttgtagcacctgtgttgaatccattcatttacagtttaagaaacaatgaactgaaggggactttaaaaaagaccctaagccggccgggcgcggtggctcacgcctgtaatcccagcactttgggaggccgaggcgggtggatcatgaggtcaggagatcgagaccatcctggctaa

SEQ ID NO: 141 - protein, 314 aa, Homo sapiens
MENNTEVSEFILLGLTNAPELQVPLFIMFTLIYLITLTGNLGMIILILLDSHLHTPMYFFLSNLSLAGIGYSSAVTPKVLTGLLIEDKAISYSACAAQMFFCAVFATVENYLLSSMAYDRYAAVCNPLHYTTTMTTRVCACLAIGCYVIGFLNASIQIGDTFRLSFCMSNVIHHFFCDKPAVITLTCSEKHISELILVLISSFNVFFALLVTLISYLFILITILKRHTGKGYQKPLSTCGSHLIAIFLFYITVIIMYIRPSSSHSMDTDKIASVFYTMIIPMLSPIVYTLRNKDVKNAFMKVVEKAKYSLDSVF

SEQ ID NO: 142 - DNA, 945 bp, Homo sapiens
atggagaataatacagaggtgagtgaattcatcctgcttggtctaaccaatgccccagaactacaggttcccctctttatcatgtttaccctcatctacctcatcactctgactgggaacctggggatgatcatattaatcctgctggactctcatctccacactcccatgtacttttttctcagtaacctgtctcttgcaggcattggttactcctcagctgtcactccaaaggttttaactgggttgcttatagaagacaaagccatctcctacagtgcctgtgctgctcagatgttcttttgtgcagtctttgccactgtggaaaattacctcttgtcctcaatggcctatgaccgctacgcagcagtgtgtaaccccctacattataccaccaccatgacaacacgtgtgtgtgcttgtctggctataggctgttatgtcattggttttctgaatgcttctatccaaattggagatacatttcgcctctctttctgcatgtccaatgtgattcatcactttttctgtgacaaaccagcagtcattactctgacctgctctgagaaacacattagtgagttgattcttgttcttatatcaagttttaatgtcttttttgcacttcttgttaccttgatttcctatctgttcatattgatcaccattcttaagaggcacacaggtaagggataccagaagcctttatctacctgtggttctcacctcattgccattttcttattttatataactgtcatcatcatgtacatacgaccaagttccagtcattccatggacacagacaaaattgcatctgtgttctacactatgatcatccccatgctcagtcctatagtctataccctgaggaacaaagacgtgaagaatgcattcatgaaggttgttgagaaggcaaaatattctctagattcagtcttttaa

SEQ ID NO: 143 - protein, 314 aa, Homo sapiens
MGDVNQSVASDFILVGLFSHSGSRQLLFSLVAVMFVIGLLGNTVLLFLIRVDSRLHTPMYFLLSQLSLFDIGCPMVTIPKMASDFLRGEGATSYGGGAAQIFFLTLMGVAEGVLLVLMSYDRYVAVCQPLQYPVLMRRQVCLLMMGSSWVVGVLNASIQTSITLHFPYCASRIVDHFFCEVPALLKLSCADTCAYEMALSTSGVLILMLPLSLIATSYGHVLQAVLSMRSEEARHKAVTTCSSHITVVGLFYGAAVFMYMVPCAYHSPQQDNVVSLFYSLVTPTLNPLIYSLRNPEVWMALVKVLSRAGLRQMC

SEQ ID NO: 144 - DNA, 945 bp, Homo sapiens
atgggggatgtgaatcagtcggtggcctcagacttcattctggtgggcctcttcagtcactcaggatcacgccagctcctcttctccctggtggctgtcatgtttgtcataggccttctgggcaacaccgttcttctcttcttgatccgtgtggactcccggctccacacacccatgtacttcctgctcagccagctctccctgtttgacattggctgtcccatggtcaccatccccaagatggcatcagactttctgcggggagaaggtgccacctcctatggaggtggtgcagctcaaatattcttcctcacactgatgggtgtggctgagggcgtcctgttggtcctcatgtcttatgaccgttatgttgctgtgtgccagcccctgcagtatcctgtacttatgagacgccaggtatgtctgctgatgatgggctcctcctgggtggtaggtgtgctcaacgcctccatccagacctccatcaccctgcattttccctactgtgcctcccgtattgtggatcacttcttctgtgaggtgccagccctactgaagctctcctgtgcagatacctgtgcctacgagatggcgctgtccacctcaggggtgctgatcctaatgctccctctttccctcatcgccacctcctacggccacgtgttgcaggctgttctaagcatgcgctcagaggaggccagacacaaggctgtcaccacctgctcctcgcacatcacggtagtggggctcttttatggtgccgccgtgttcatgtacatggtgccttgcgcctaccacagtccacagcaggataacgtggtttccctcttctatagccttgtcacccctacactcaacccccttatctacagtctgaggaatccggaggtgtggatggctttggtcaaagtgcttagcagagctggactcaggcaaatgtgctga

SEQ ID NO: 145 - protein, 331 aa, Homo sapiens
MSPDGNHSSDPTEFVLAGLPNLNSARVELFSVFLLVYLLNLTGNVLIVGVVRADTRLQTPMYFFLGNLSCLEILLTSVIIPKMLSNFLSRQHTISFAACITQFYFYFFLGASEFLLLAVMSADRYLAICHPLRYPLLMSGAVCFRVALACWVGGLVPVLGPTVAVALLPFCKQGAVVQHFFCDSGPLLRLACTNTKKLEETDFVLASLVIVSSLLITAVSYGLIVLAVLSIPSASGRQKAFSTCTSHLIVVTLFYGSAIFLYVRPSQSGSVDTNWAVTVITTFVTPLLNPFIYALRNEQVKEALKDMFRKVVAGVLGNLLLDKCLSEKAVK

SEQ ID NO: 146 - DNA, 996 bp, Homo sapiens
atgagtcctgatgggaaccacagtagtgatccaacagagttcgtcctggcagggctcccaaatctcaacagcgcaagagtggaattattttctgtgtttcttcttgtctatctcctgaatctgacaggcaatgtgttgattgtgggggtggtaagggctgatactcgactacagacccctatgtacttctttctgggtaacctgtcctgcctagagatactgctcacttctgtcatcattccaaagatgctgagcaatttcctctcaaggcaacacactatttcctttgctgcatgtatcacccaattctatttctacttctttctcggggcctccgagttcttactgttggctgtcatgtctgcggatcgctacctggccatctgtcatcctctgcgctaccccttgctcatgagtggggctgtgtgctttcgtgtggccttggcctgctgggtggggggactcgtccctgtgcttggtcccacagtggctgtggccttgcttcctttctgtaagcagggtgctgtggtacagcacttcttctgcgacagtggcccactgctccgcctggcttgcaccaacaccaagaagctggaggagactgactttgtcctggcctccctcgtcattgtatcttccttgctgatcactgctgtgtcctacggcctcattgtgctggcagtcctgagcatcccctctgcttcaggccgtcagaaggccttctctacctgtacctcccacttgatagtggtgaccctcttctatggaagtgccatttttctctatgtgcggccatcgcagagtggttctgtggacactaactgggcagtgacagtaataacgacatttgtgacaccactgttgaatccattcatctatgccttacgtaatgagcaagtcaaggaagctttgaaggacatgtttaggaaggtagtggcaggcgttttagggaatcttttacttgataaatgtctcagtgagaaagcagtaaagtaa

SEQ ID NO: 147 - protein, 319 aa, Homo sapiens
MTPGELALASGNHTPVTKFILQGFSNYPDLQELLFGAILLIYAITVVGNLGMMALIFTDSHLQSPMYFFLNVLSFLDICYSSVVTPKLLVNFLVSDKSISFEGCVVQLAFFVVHVTAESFLLASMAYDRFLAICQPLHYGSIMTRGTCLQLVAVSYAFGGANSAIQTGNVFALPFCGPNQLTHYYCDIPPLLHLACANTATARVVLYVFSALVTLLPAAVILTSYCLVLVAIGRMRSVAGREKDLSTCASHFLAIAIFYGTVVFTYVQPHGSTNNTNGQVVSVFYTIIIPMLNPFIYSLRNKEVKGALQRKLQVNIFPG

SEQ ID NO: 148 - DNA, 960 bp, Homo sapiens
atgacacctggagaactagcccttgccagtggcaaccacaccccagtcaccaagttcatcttgcagggattctccaattatccagacctccaggagcttctcttcggagccatcctgctcatctatgccataacagtggtgggcaacttgggaatgatggcactcatcttcacagactcccatctccaaagcccaatgtatttcttcctcaatgtcctctcgtttcttgatatttgttactcttctgtggtcacacctaagctcttggtcaacttcctggtctctgacaagtccatctcttttgagggctgtgtggtccagctcgccttctttgtagtgcatgtgacagctgagagcttcctgctggcctccatggcctatgaccgcttcctagccatctgtcaacccctccattatggttctatcatgaccagggggacctgtctccagctggtagctgtgtcctatgcatttggtggagccaactccgctatccagactggaaatgtctttgccctgcctttctgtgggcccaaccagctaacacactactactgtgacataccaccccttctccacctggcttgtgccaacacagccacagcaagagtggtcctctatgtcttttctgctctggtcacccttctgcctgctgcagtcattctcacctcctactgcttggtcttggtggccattgggaggatgcgctcagtagcagggagggagaaggacctctccacttgtgcctcccactttctggccattgccattttctatggcactgtggttttcacctatgttcagccccatggatctactaacaataccaatggccaagtagtgtccgtcttctacaccatcataattcccatgctcaatcccttcatctatagcctccgcaacaaggaggtgaagggcgctctgcagaggaagcttcaggtcaacatctttcccggctga

SEQ ID NO: 149 - protein, 309 aa, Homo sapiens
MEGINKTAKMQFFFRPFSPDPEVQMLIFVVFLMMYLTSLGGNATIAVIVQINHSLHTPMYFFLANLAVLEIFYTSSITPLALANLLSMGKTPVSITGCGTQMFFFVFLGGADCVLLVVMAYDRFIAICHPLRYRLIMSWSLCVELLVGSLVLGFLLSLPLTILIFHLPFCHNDEIYHFYCDMPAVMRLACADTRVHKTALYIISFIVLSIPLSLISISYVFIVVAILRIRSAEGRQQAYSTCSSHILVVLLQYGCTSFIYLSPSSSYSPEMGRVVSVAYTFITPILNPLIYSLRNKELKDALRKALRKF

SEQ ID NO: 150 - DNA, 930 bp, Homo sapiens
atggaaggaataaataaaactgcaaagatgcagtttttctttcgtccattctcacctgaccctgaggtccagatgctgatttttgtggtcttcctgatgatgtatctgaccagcctcggtggaaatgctacaattgcagtcattgttcagatcaatcattccctccacacccccatgtactttttcctggctaatctggcagttctagaaatcttctatacatcttccatcaccccattggccttggcaaacctcctttcaatgggcaaaactcctgtttccatcacgggatgtggcacccagatgtttttctttgtcttcttgggtggggctgattgtgtcctgctggtagtcatggcttatgaccggtttatagcgatctgtcaccctctgcgatacaggctcatcatgagctggtccttgtgtgtggagctgctggtaggctccttggtgctggggttcctgttgtcactgccactcaccattttaatcttccatctcccattctgccacaatgatgagatctaccacttctactgtgacatgcctgcagtcatgcgcctggcttgtgcagacacacgcgttcacaagactgctctgtatatcatcagcttcatcgtccttagcatccccctctcattgatctccatctcctatgtcttcatcgtggtagccattttacggatccggtcagcagaagggcgccagcaagcctactctacctgctcttctcacatcttagtggtcctcctgcagtatggctgcaccagctttatatacttgtcccccagttccagctactctcctgagatgggccgggtggtatctgtggcctacacatttatcactcccattttaaaccccttgatctatagtttgaggaacaaggaactgaaagatgccctaaggaaagcattgagaaaattctag

SEQ ID NO: 151 - protein, 409 aa, Homo sapiens
MGVKNHSTVTEFLLSGLTEQAELQLPLFCLFLGIYTVTVVGNLSMISIIRLNRQLHTPMYYFLSSLSFLDFCYSSVITPKMMKLWMESHLIVPETRPSPRMMSNQTLVTEFILQGFSEHPEYRVFLFSCFLFLYSGALTGNVLITLAITFNPGLHAPMYFFLLNLATMDIICTSSIMPKALASLVSEESSISYGGCMAQLYFLTWAASSELLLLTVMAYDRYAAICHPLHYSSMMSKVFCSGLATAVWLLCAVNTAIHTGLMLRLDFCGPNVIIHFFCEVPPLLLLSCSSTYVNGVMIVLADAFYGIVNFLMTIASYGFIVSSILKVKTAWGRQKAFSTCSSHLTVVCMYYTAVFYAYISPVSGYSAGKSKLAGLLYTVLSPTLNPLIYTLRNKEVKAALRKLFPFFRN

SEQ ID NO: 152 - DNA, 987 bp, Homo sapiens
atgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaa

SEQ ID NO: 153 - protein, 310 aa, Homo sapiens
MQLNNNVTEFILLGLTQDPFWKKIVFVIFLRLYLGTLLGNLLIIISVKASQALKNPMFFFLFYLSLSDTCLSTSIAPRMIVDALLKKTTISFSECMIQVFSSHVFGCLEIFILILTAVDRYVDICKPLHYMTIISQWVCGVLMAVAWVGSCVHSLVQIFLALSLPFCGPNVINHCFCDLQPLLKQACSETYVVNLLLVSNSGAICAVSYVMLIFSYVIFLHSLRNHSAEVIKKALSTCVSHIIVVILFFGPCIFMYTCPATVFPMDKMIAVFYTVGTSFLNPVIYTLKNTEVKSAMRKLWSKKLITDDKR

SEQ ID NO: 154 - DNA, 933 bp, Homo sapiens
atgcaactgaataataatgtgactgagttcattctgcttggattgacacaggatcctttttggaagaaaatagtgtttgttatttttttgcgtctctacttgggaacactgttgggtaatttgctaatcattattagtgtcaaggccagccaggcacttaagaacccaatgttcttcttccttttctacttatctttatctgatacttgcctctctacttccatagcccctagaatgattgtggatgcccttttgaagaagacaactatctccttcagcgagtgcatgatccaagtcttttcatcccatgtctttggctgcctggagatcttcatcctcatcctcacggctgttgaccgctatgtggacatctgtaagcccctgcactacatgaccatcataagccagtgggtctgtggtgttttgatggctgtggcctgggtgggatcctgtgtgcattctttagttcagatttttcttgccctgagtttgccattctgtggccccaatgtgatcaatcactgtttctgtgacttgcagcccttgttgaaacaagcctgttcagaaacctatgtggttaacctactcctggtttccaatagtggggccatttgtgcagtgagttatgtcatgctaatattctcctatgtcatcttcttgcattctctgagaaaccacagtgctgaagtgataaagaaagcactttccacatgtgtctcccacatcattgtggtcatcttgttctttggaccttgcatatttatgtacacatgccctgcaaccgtattccccatggataagatgatagctgtattttatacagttggaacatcttttctcaaccctgtgatttacacgctgaagaatacagaagtgaaaagtgccatgaggaagctttggagcaagaaattgatcacagatgacaaaagataa

SEQ ID NO: 155 - protein, 347 aa, Homo sapiens
MGNWTAAVTEFVLLGFSLSREVELLLLVLLLPTFLLTLLGNLLIISTVLSCSRLHTPMYFFLCNLSILDILFTSVISPKVLANLGSRDKTISFAGCITQCYFYFFLGTVEFLLLTVMSYDRYATICCPLRYTTIMRPSVCIGTVVFSWVGGFLSVLFPTILISQLPFCGSNIINHFFCDSGPLLALACADTTAIELMDFMLSSMVILCCIVLVAYSYTYIILTIVRIPSASGRKKAFNTCASHLTIVIIPSGITVFIYVTPSQKEYLEINKIPLVLSSVVTPFLNPFIYTLRNDTVQGVLRDVWVRVRGVFEKRMRAVLRSRLSSNKDHQGRACSSPPCVYSVKLQC

SEQ ID NO: 156 - DNA, 1044 bp, Homo sapiens
atgggtaactggactgcagcggtgactgagtttgttctgctggggttttccctgagcagggaggtggagctgctgctcctggtgctcctgctgcccacgttcctgctgactcttctggggaacctgctcatcatctccactgtgctgtcctgctcccgcctccacacccccatgtacttcttcttgtgcaacctctctatcctggacatcctcttcacctcagtcatctctccaaaagtgttggccaacttaggatctagggataaaaccatctcctttgccggatgtatcacccagtgctatttctactttttcttgggcacagttgagttcctcctgctgacggtcatgtcctatgaccgttatgccaccatctgctgccccctgcggtacaccaccatcatgagaccttctgtctgcattgggaccgttgtattctcttgggtgggaggcttcctgtctgtgctctttccaaccatcctcatctcccagctgcccttctgtggctccaatatcattaaccacttcttctgtgacagtggacccttgctggccctggcctgtgcagacaccactgccatcgagctgatggattttatgctttcttccatggtcatcctctgctgcatagtcctcgtggcctattcctatacgtacatcatcttgaccatagtgcgcattccttctgcaagtggaaggaagaaggcctttaatacctgtgcttcccacctgaccatagtcatcattcctagtggcatcactgtgtttatctatgtgactccctcccagaaagaatatctggagatcaacaagatccctttggttctgagcagtgtggtgactccattcctcaacccctttatatatactctgaggaatgacacagtgcagggagtcctcagggatgtgtgggtcagggttcgaggagtttttgaaaagaggatgagggcagtgctgagaagcagattatcctccaacaaagaccaccaaggaagggcttgctcttctccaccatgtgtctattctgtaaagctccagtgttag

SEQ ID NO: 157 - protein, 309 aa, Homo sapiens
MGAKNNVTEFVLFGLFESREMQHTCFVVFFLFHVLTVLGNLLVIITINARKTLKSPMYFFLSQLSFADICYPSTTIPKMIADTFVEHKIISFNGCMTQLFSAHFFGGTEIFLLTAMAYDRYVAICRPLHYTAIMDCRKCGLLAGASWLAGFLHSILQTLLTVQLPFCGPNEIDNFFCDVHPLLKLACADTYMVGLIVVANSGMISLASFFILIISYVIILLNLRSQSSEDRRKAVSTCGSHVITVLLVLMPPMFMYIRPSTTLAADKLIILFNIVMPPLLNPLIYTLRNNDVKNAMRKLFRVKRSLGEK

SEQ ID NO: 158 - DNA, 930 bp, Homo sapiens
atgggtgccaagaacaatgtgactgagtttgttttatttggcctttttgagagcagagagatgcagcatacatgctttgtggtattcttcctctttcatgtgctcactgtcctggggaaccttctggtcatcatcaccatcaatgctagaaagaccctgaagtctcccatgtatttcttcctgagccagttgtcttttgctgacatatgttatccatccactaccatacccaagatgattgctgacacttttgtggagcataagatcatctccttcaatggctgcatgacccagctcttttctgcccacttctttggtggcactgagatcttcctccttacagccatggcctatgaccgctatgtggccatctgtaggcccctgcactacacagccatcatggattgccggaagtgtggcctgctagcgggggcctcctggttagctggcttcctgcattccatcctgcagaccctcctcacggttcagctgcctttttgtgggcccaatgagatagacaacttcttctgtgatgttcatcccctgctcaagttggcctgtgcagacacctacatggtaggtctcatcgtggtggccaacagcggtatgatttctttagcatccttttttatccttatcatttcctatgttatcatcttactgaacctaagaagccagtcatctgaggaccggcgtaaggctgtctccacatgtggctcacacgtaatcactgtccttttggttctcatgccccccatgttcatgtacattcgtccctccaccaccctggctgctgacaaacttatcatcctctttaacattgtgatgccacctttgctgaaccctttgatctatacactaaggaacaacgatgtgaaaaatgccatgaggaagctgtttagggtcaagaggagcttaggggagaagtga

SEQ ID NO: 159 - protein, 329 aa, Homo sapiens
MQLVLLLMFLLVFIGNTAPAFSVTLESMDIPQNITEFFMLGLSQNSEVQRVLFVVFLLIYVVTVCGNMLIVVTITSSPTLASPVYFFLANLSFIDTFYSSSMAPKLIADSLYEGRTISYECCMAQLFGAHFLGGVEIILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNAMRKLFTW

SEQ ID NO: 160 - DNA, 990 bp, Homo sapiens
atgcaattagttctattacttatgtttctccttgtctttataggcaatactgcacctgcattctcagtgaccttggaatctatggacataccacaaaatatcacagaatttttcatgctggggctctcacagaactcagaggtacagagagttctctttgtggtctttttgctgatctatgtggtcacggtttgtggcaacatgctcattgtggtcactatcacctccagccccacgctggcttcccctgtgtattttttcctggccaacctatcctttattgacaccttttattcttcttctatggctcctaaactcattgctgactcattgtatgaggggagaaccatctcttatgagtgctgcatggctcagctctttggagctcattttttgggaggtgttgagatcattctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaatgccatgagaaagctctttacatggtaa

SEQ ID NO: 161 - protein, 359 aa, Homo sapiens
MNNIAQLSLGFIDLGIPSVLQKIILTKIILLFKMYVSNCNPCAIHRKINYPNTKLDFEQVNNITEFILLGLTQNAEAQKLLFAVFTLIYFLTMVDNLIIVVTITTSPALDSPVYFFLSFFSFIDGCSSSTMAPKMIFDLLTEKKTISFSGCMTQLFVEHFFGGVEIILLVVMAYDCYVAICKPLYYLITMNRQVCGLLVAMAWVGGFLHALIQMLLIVWLPFCGPNVIDHFICDLFPLLKLSCTDTHVFGLFVAANSGLMCMLIFSILITSYVLILCSQRKALSTCAFHITVVVLFFVPCILVYLRPMITFPIDKAVSVFYTVVTPMLNPLIYTLRNTEVKNAMKQLWSQIIWGNNLCD

SEQ ID NO: 162 - DNA, 1080 bp, Homo sapiens
atgaataacatagctcaacttagtcttgggtttatagatttagggattccatcagtgttacagaaaataatcctgaccaaaattattttattgttcaaaatgtatgtgtcaaattgcaatccttgtgctattcacagaaaaatcaattatccaaataccaaactggatttcgagcaagtgaacaacataacggaattcatcttgcttggcctgacacagaacgcagaggcacagaaactcttgtttgctgtgtttacactcatctactttctcaccatggtagacaacctaatcattgtggtgacaatcaccaccagcccagccctggactcccccgtgtatttttttctgtctttcttttccttcatagatggctgctcctcttctaccatggcccccaaaatgatatttgacttactcactgaaaagaaaactatttccttcagtgggtgcatgacccagctctttgtagaacatttctttgggggagttgagatcattctgctcgtggtgatggcctatgactgctatgtggccatctgcaagcccctgtactacctgatcacaatgaacaggcaggtatgtggcctcctggtggccatggcatgggtcgggggatttcttcacgctctgattcaaatgcttttaatagtctggctgcccttctgtggccccaatgtcattgaccatttcatctgtgaccttttccctctgctaaaactctcctgcactgacactcacgtctttggactctttgttgccgccaacagtgggctgatgtgtatgctcattttttctattcttattacctcttacgtcctaatcctctgctcacagcggaaggctctctctacctgcgccttccatatcactgtagtcgtcctattctttgttccctgtatattggtgtaccttcgacccatgatcaccttccctattgataaagctgtgtctgtgttttatactgtggtaacacccatgttaaaccctttaatctacaccctcagaaacacagaggtgaaaaatgccatgaagcagctctggagccaaataatctggggtaacaatttgtgtgattag

SEQ ID NO: 163 - protein, 323 aa, Homo sapiens
MWQKNQTSLADFILEGLFDDSLTHLFLFSLTMVVFLIAVSGNTLTILLICIDPQLHTPMYFLLSQLSLMDLMHVSTIILKMATNYLSGKKSISFVGCATQHFLYLCLGGAECFLLAVMSYDRYVAICHPLRYAVLMNKKVGLMMAVMSWLGASVNSLIHMAILMHFPFCGPRKVYHFYCEFPAVVKLVCGDITVYETTVYISSILLLLPIFLISTSYVFILQSVIQMRSSGSKRNAFATCGSHLTVVSLWFGACIFSYMRPRSQCTLLQNKVGSVFYSIITPTLNSLIYTLRNKDVAKALRRVLRRDVITQCIQRLQLWLPRV

SEQ ID NO: 164 - DNA, 972 bp, Homo sapiens
atgtggcagaagaatcagacctctctggcagacttcatccttgaggggctcttcgatgactcccttacccaccttttccttttctccttgaccatggtggtcttccttattgcggtgagtggcaacaccctcaccattctcctcatctgcattgatccccagcttcatacaccaatgtatttcctgctcagccagctctccctcatggatctgatgcatgtctccacaatcatcctgaagatggctaccaactacctatctggcaagaaatctatctcctttgtgggctgtgcaacccagcacttcctctatttgtgtctaggtggtgctgaatgttttctcttagctgtcatgtcctatgaccgctatgttgccatctgtcatccactgcgctatgctgtgctcatgaacaagaaggtgggactgatgatggctgtcatgtcatggttgggggcatccgtgaactccctaattcacatggcgatcttgatgcacttccctttctgtgggcctcggaaagtctaccacttctactgtgagttcccagctgttgtgaagttggtatgtggcgacatcactgtgtatgagaccacagtgtacatcagcagcattctcctcctcctccccatcttcctgatttctacatcctatgtcttcatccttcaaagtgtcattcagatgcgctcatctgggagcaagagaaatgcctttgccacttgtggctcccacctcacggtggtttctctttggtttggtgcctgcatcttctcctacatgagacccaggtcccagtgcactctattgcagaacaaagttggttctgtgttctacagcatcattacgcccacattgaattctctgatttatactctccggaataaagatgtagctaaggctctgagaagagtgctgaggagagatgttatcacccagtgcattcaacgactgcaattgtggttgccccgagtgtag

SEQ ID NO: 165 - protein, 348 aa, Homo sapiens [sequence omitted]

SEQ ID NO: 166 - DNA, 1047 bp, Homo sapiens
atgctggaccccagtatttccagtcacactctttatctccactctctgtttcctcagggattgagaaaggggacaatgtggcagaagaatcagacctctctggcagacttcatccttgaggggctcttcgatgactcccttacccaccttttccttttctccttgaccatggtggtcttccttattgcggtgagtggcaacaccctcaccattctcctcatctgcattgatccccagcttcatacaccaatgtatttcctgctcagccagctctccctcatggatctgatgcatgtctccacaaccatcctgaagatggctaccaactacctatctggcaagaaatctatctcctttgtgggctgtgcaacccagcacttcctctatttgtgtctaggtggtgctgaatgttttctcttagctgtcatgtcctatgaccgctatgttgccatctgtcatccactgcgctatgctgtgctcatgaacaagaaggtgggactgatgatggctgtcatgtcatggttgggggcatccgtgaactccctaattcacatggcgatcttgatgcacttccctttctgtgggcctcggaaagtctaccacttctactgtgagttcccagctgttgtgaagttggtatgtggcgacatcactgtgtatgagaccacagtgtacatcagcagcattctcctcctcctccccatcttcctgatttctacatcctatgtcttcatccttcaaagtgtcattcagatgcgctcatctgggagcaagagaaatgcctttgccacttgtggctcccacctcacggtggtttctctttggtttggtgcctgcatcttctcctacatgagacccaggtcccagtgcactctattgcagaacaaagttggttctgtgttctacagcatcattacgcccacattgaattctctgatttatactctccggaataaagatgtagctaaggctctgagaagagtgctgaggagagatgttatcacccagtgcattcaacgactgcaattgtggttgccccgagtgtag

SEQ ID NO: 167 - protein, 370 aa, Homo sapiens; identical to SEQ ID NO: 105

SEQ ID NO: 168 - DNA, 1113 bp, Homo sapiens; identical to SEQ ID NO: 106

SEQ ID NO: 169 - protein, 313 aa, Homo sapiens
MGNWSTVTEITLIAFPALLEIRISLFVVLVVTYTLTATGNITIISLIWIDHRLQTPMYFFLSNLSFLDILYTTVITPKLLACLLGEEKTISFAGCMIQTYFYFFLGTVEFILLAVMSFDRYMAICDPLHYTVIMNSRACLLLVLGCWVGAFLSVLFPTIVVTRLPYCRKEINHFFCDIAPLLQVACINTHLIEKINFLLSALVILSSLAFTTGSYVYIISTILRIPSTQGRQKAFSTCASHITVVSIAHGSNIFVYVRPNQNSSLDYDKVAAVLITVVTPLLNPFIYSLRNEKVQEVLRETVNRIMTLIQRKT

SEQ ID NO: 170 - DNA, 942 bp, Homo sapiens
atgggaaactggagcactgtgactgaaatcaccctaattgccttcccagctctcctggagattcgaatatctctcttcgtggttcttgtggtaacttacacattaacagcaacaggaaacatcaccatcatctccctgatatggattgatcatcgcctgcaaactccaatgtacttcttcctcagtaatttgtcctttctggatatcttatacaccactgtcattaccccaaagttgttggcctgcctcctaggagaagagaaaaccatatcttttgctggttgcatgatccaaacatatttctacttctttctggggacggtggagtttatcctcttggcggtgatgtcctttgaccgctacatggctatctgcgacccactgcactacacggtcatcatgaacagcagggcctgccttctgctggttctgggatgctgggtgggagccttcctgtctgtgttgtttccaaccattgtagtgacaaggctaccttactgtaggaaagaaattaatcatttcttctgtgacattgcccctcttcttcaggtggcctgtataaatactcacctcattgagaagataaactttctcctctctgcccttgtcatcctgagctccctggcattcactactgggtcctacgtgtacataatttctaccatcctgcgtatcccctccacccagggccgtcagaaagctttttctacctgtgcttctcacatcactgttgtctccattgcccacgggagcaacatctttgtgtatgtgagacccaatcagaactcctcactggattatgacaaggtggccgctgtcctcatcacagtggtgacccctctcctgaacccttttatctacagcttgaggaatgagaaggtacaggaagtgttgagagagacagtgaacagaatcatgaccttgatacaaaggaaaacttga

SEQ ID NO: 171 - protein, 312 aa, Homo sapiens
MRNGTVITEFILLGFPVIQGLQTPLFIAIFLTYILTLAGNGLIIATVWAEPRLQIPMYFFLCNLSFLEIWYTTTVIPKLLGTFVVARTVICMSCCLLQAFFHFFVGTTEFLILTIMSFDRYLTICNPLHHPTIMTSKLCLQLALSSWVVGFTIVFCQTMLLIQLPFCGNNVISHFYCDVGPSLKAACIDTSILELLGVIATILVIPGSLLFNMISYIYILSAILRIPSATGHQKTFSTCASHLTVVSLLYGAVLFMYLRPTAHSSFKINKVVSVLNTILTPLLNPFIYTIRNKEVKGALRKAMTCPKTGHAK

SEQ ID NO: 172 - DNA, 939 bp, Homo sapiens
atgagaaatggcacagtaatcacagaattcatcctgctaggctttcctgttatccaaggcctacaaacacctctctttattgcaatctttctcacctacatattaacccttgcaggcaatgggcttattattgccactgtgtgggctgagcccaggctacaaattccaatgtacttcttcctttgtaacttgtctttcttagaaatctggtacaccaccacagtcatccccaaactgctaggaacctttgtagtggcaagaacagtaatctgcatgtcctgctgcctgctgcaggccttcttccacttcttcgtgggcaccaccgagttcttgatcctcactatcatgtcttttgaccgctacctcaccatctgcaatccccttcaccaccccaccatcatgaccagcaaactctgcctgcagctggccctgagctcctgggtggtgggcttcaccattgtcttttgtcagacgatgctgctcatccagttgccattctgtggcaataatgttatcagtcatttctactgtgatgttgggcccagtttgaaagccgcctgcatagacaccagcattttggaactcctgggcgtcatagcaaccatccttgtgatcccagggtcacttctctttaatatgatttcttatatctacattctgtccgcaatcctacgaattccttcagccactggccaccaaaagactttctctacctgtgcctcgcacctgacagttgtctccctgctctacggggctgttctgttcatgtacctaagacccacagcacactcctcctttaagattaataaggtggtgtctgtgctaaatactatcctcaccccccttctgaatccctttatttatactattagaaacaaggaggtgaagggagccttaagaaaggcaatgacttgcccaaagactggtcatgcaaagtaa

SEQ ID NO: 173 - protein, 314 aa, Homo sapiens
MLMNYSSATEFYLLGFPGSEELHHILFAIFFFFYLVTLMGNTVIIMIVCVDKRLQSPMYFFLGHLSALEILVTTIIVPVMLWGLLLPGMQTIYLSACVVQLFLYLAVGTTEFALLGAMAVDRYVAVCNPLRYNIIMNRHTCNFVVLVSWVFGFLFQIWPVYVMFQLTYCKSNVVNNFFCDRGQLLKLSCNNTLFTEFILFLMAVFVLFGSLIPTIVSNAYIISTILKIPSSSGRRKSFSTCASHFTCVVIGYGSCLFLYVKPKQTQAADYNWVVSLMVSVVTPFLNPFIFTLRNDKVIEALRDGVKRCCQLFRN

SEQ ID NO: 174 - DNA, 945 bp, Homo sapiens
atgttgatgaattactctagtgccactgaattttatctccttggcttccctggctctgaagaactacatcatatcctttttgctatattcttctttttctacttggtgacattaatgggaaacacagtcatcatcatgattgtctgtgtggataaacgtctgcagtcccccatgtatttcttcctcggccacctctctgccctggagatcctggtcacaaccataatcgtccccgtgatgctttggggattgctgctccctgggatgcagacaatatatttgtctgcctgtgttgtccagctcttcttgtaccttgctgtggggacaacagagttcgcattacttggagcaatggctgtggaccgttatgtggctgtctgtaaccctctgaggtacaacatcattatgaacagacacacctgcaactttgtggttcttgtgtcatgggtgtttgggtttctttttcaaatctggccggtctatgtcatgtttcagcttacttactgcaaatcaaatgtggtgaacaattttttttgtgaccgagggcaattgctcaaactatcctgcaataatactcttttcacggagtttatcctcttcttaatggctgtttttgttctctttggttctttgatccctacaattgtctccaacgcctacatcatctccaccattctcaagatcccgtcatcctctggccggaggaaatccttctccacttgtgcctcccacttcacctgtgttgtgattggctacggcagctgcttgtttctctacgtgaaacccaagcaaacgcaggcagctgattacaattgggtagtttccctgatggtttcagtagtaactcctttcctcaatcctttcatcttcaccctccggaatgataaagtcatagaggcccttcgggatggggtgaaacgctgctgtcaactattcaggaattag

SEQ ID NO: 175 - protein, 315 aa, Homo sapiens
METWVNQSYTDGFFLLGIFSHSTADLVLFSVVMAVFTVALCGNVLLIFLIYMDPHLHTPMYFFLSQLSLMDLMLVCTNVPKMAANFLSGRKSISFVGCGIQIGLFVCLVGSEGLLLGLMAYDRYVAISHPLHYPILMNQRVCLQITGSSWAFGIIDGLIQMVVVMNFPYCGLRKVNHFFCEMLSLLKLACVDTSLFEKVIFACCVFMLLFPFSIIVASYAHILGTVLQMHSAQAWKKALATCSSHLTAVTLFYGAAMFIYLRPRHYRAPSHDKVASIFYTVLTPMLNPLIYSLRNREVMGALRKGLDRCRIGSQH

SEQ ID NO: 176 - DNA, 948 bp, Homo sapiens
atggagacgtgggtgaaccagtcctacacagatggcttcttcctcttaggcatcttctcccacagtactgctgaccttgtcctcttctccgtggttatggcggtcttcacagtggccctctgtgggaatgtcctcctcatcttcctcatctacatggaccctcaccttcacacccccatgtacttcttcctcagccagctctccctcatggacctcatgttggtctgtaccaatgtgccaaagatggcagccaacttcctgtctggcaggaagtccatctcctttgtgggctgtggcatacaaattggcctctttgtctgtcttgtgggatctgaggggctcttgctgggactcatggcttatgaccgctatgtggccattagccacccacttcactatcccatcctcatgaatcagagggtctgtctccagattactgggagctcctgggcctttgggataatcgatggcttgatccagatggtggtagtaatgaatttcccctactgtggcttgaggaaggtgaaccatttcttctgtgagatgctatccttgttgaagctggcctgtgtagacacatccctgtttgagaaggtgatatttgcttgctgtgtcttcatgcttctcttcccattctccatcatcgtggcctcctatgctcacattctagggactgtgctgcaaatgcactctgctcaggcctggaaaaaggccctggccacctgctcctcccacctgacagctgtcaccctcttctatggggcagccatgttcatctacctgaggcctaggcactaccgggcccccagccatgacaaggtggcctctatcttctacacggtccttactcccatgctcaaccccctcatttacagcttgaggaacagggaggtgatgggggcactgaggaaggggctggaccgctgcaggatcggcagccagcactga

SEQ ID NO: 177 - protein, 335 aa, Homo sapiens
MLGSKPRVHLYILPCASQQVSTMGDRGTSNHSEMTDFILAGFRVRPELHILLFLLFLFVYAMILLGNVGMMTIIMTDPRLNTPMYFFLGNLSFIDLFYSSVIEPKAMINFWSENKSISFAGCVAQLFLFALLIVTEGFLLAAMAYDRFIAICNPLLYSVQMSTRLCTQLVAGSYFCGCISSVIQTSMTFTLSFCASRAVDHFYCDSRPLQRLSCSDLFIHRMISFSLSCIIILPTIIVIIVSYMYIVSTVLKIHSTEGHKKAFSTCSSHLGVVSVLYGAVFFMYLTPDRFPELSKVASLCYSLVTPMLNPLIYSLRNKDVQEALKKFLEKKNIIL

SEQ ID NO: 178 - DNA, 1008 bp, Homo sapiens
atgctaggatccaaaccaagagttcatttgtatattttgccctgtgcctctcaacaggtttctaccatgggtgacaggggaacaagcaatcactcagaaatgactgacttcattcttgcaggcttcagggtacgcccagagctccacattctcctcttcctgctatttttgtttgtttatgccatgatccttctagggaatgttgggatgatgaccattattatgactgatcctcggctgaacacaccaatgtattttttcctaggcaatctctccttcattgatcttttctattcatctgttattgaacccaaggctatgatcaacttctggtctgaaaacaagtctatctcctttgcaggctgtgtggcccagctctttctctttgccctcctcattgtgactgagggatttctcctggcggccatggcttatgaccgctttattgccatctgcaaccctctgctctactctgttcaaatgtccacacgtctgtgtactcagttggtggctggttcctatttttgtggctgcattagctcagttattcagactagcatgacatttactttatctttttgcgcttctcgggctgttgaccacttttactgtgattctcgcccacttcagagactgtcttgttctgatctctttatccatagaatgatatctttttccttatcatgtattattatcttgcctactatcatagtcattatagtatcttacatgtatattgtgtccacagttctaaagatacattctactgagggacataagaaggccttctccacctgcagctctcacctgggagttgtgagtgtgctgtatggtgctgtcttttttatgtatctcactcctgacagatttcctgagctgagtaaagtggcatccttatgttactccctagtcactcccatgttgaatcctttgatttactctctgaggaacaaagatgtccaagaggctctaaaaaaatttctagagaagaaaaatattattctttga

SEQ ID NO: 179 - protein, 316 aa, Homo sapiens
MICENHTRVTEFILLGFTNNPEMQVSLFIFFLAIYTVTLLGNFLIVTVTSVDLALQTPMYFFLQNLSLLEVCFTLVMVPKMLVDLVSPRKIISFVGCGTQMYFFFFFGSSECFLLSMMAYDRFVAICNPLHYSVIMNRSLCLWMAIGSWMSGVPVSMLQTAWMMALPFCGPNAVDHFFCDGPPVLKLVTVDTTMYEMQALASTLLFIMFPFCLILVSYTRIIITILRMSSATGRQKAFSTCSSHLIVVSLFYGTASLTYLRPKSNQSPESKKLVSLSYTVITPMLNPIIYGLRNNEVKGAVKRTITQKVLQKLDVF

SEQ ID NO: 180 - DNA, 951 bp, Homo sapiens
atgatctgtgaaaatcacaccagagtcactgaatttattcttcttggttttacaaacaaccccgagatgcaagtttccctctttatttttttcctggccatttatacagtcactttgttgggcaactttcttattgtcacagttaccagtgtggatctcgcacttcaaacacccatgtacttctttcttcaaaatctgtcacttcttgaagtatgtttcaccttggttatggtgccaaaaatgcttgtagatctagtgtccccaaggaaaattatctcttttgtgggctgtggtacccagatgtacttcttcttcttctttggcagttctgaatgtttccttctctccatgatggcttatgatcgctttgtggccatctgtaaccctctccattattcagtcataatgaacaggtccctatgcttgtggatggccataggctcttggatgtccggtgttcctgtgtctatgctacagacagcttggatgatggcccttcctttctgtggaccaaatgccgtggaccactttttctgtgatggtcccccagtgttaaaactagtcacagtggatacaaccatgtatgaaatgcaagcacttgcctccacactcctgtttatcatgtttcccttttgtctcattttggtttcctacacccgcattatcataacaattctgaggatgtcctctgccactggccgccagaaggcattttctacttgttcctcacacctcattgtggtgtccctcttctacggaacagccagtctgacctacctgcggcccaaatcaaaccagtcccctgagagcaagaagctagtgtcattgtcctacactgtcatcacacctatgctaaaccccatcatctacggcctgaggaacaatgaagtgaaaggggctgtcaagaggacaatcactcaaaaagtcttacagaagttagatgtgttttga

SEQ ID NO: 181 - protein, 362 aa, Homo sapiens
MTEFHLQSQMPSIRLIFRRLSLGRIKPSQSPRCSTSFMVVPSFSIAEHWRRMKGANLSQGMEFELLGLTTDPQLQRLLFVVFLGMYTATLLGNLVMFLLIHVSATLHTPMYSLLKSLSFLDFCYSSTVVPQTLVNFLAKRKVISYFGCMTQMFFYAGFATSECYLIAAMAYDRYAAICNPLLYSTIMSPEVCASLIVGSYSAGFLNSLIHTGCIFSLKFCGAHVVTHFFCDGPPILSLSCVDTSLCEILLFIFAGFNLLSCTLTILISYFLILNTILKMSSAQGRFKAFSTCASHLTAICLFFGTTLFMYLRPRSSYSLTQDRTVAVIYTVVIPVLNPLMYSLRNKDVKKALIKVWGRKTME

SEQ ID NO: 182 - DNA, 1089 bp, Homo sapiens
atgacagagtttcatctgcaaagccaaatgccctcaataagactcatcttcagaaggctgtccttaggcagaattaaacccagtcagagccccaggtgttcaacctcatttatggtggtgccttctttctccatcgcagagcactggagaaggatgaaaggggcaaacctgagccaagggatggagtttgagctcttgggcctcaccactgacccccagctccagaggctgctcttcgtggtgttcctgggcatgtacacagccactctgctggggaacctggtcatgttcctcctgatccatgtgagtgccaccctgcacacacccatgtactccctcctgaagagcctctccttcttggatttctgctactcctccacggttgtgccccagaccctggtgaacttcttggccaagaggaaagtgatctcttattttggctgcatgactcagatgttcttctatgcgggttttgccaccagtgagtgctatctcatcgctgccatggcctatgaccgctatgccgctatttgtaaccccctgctctactcaaccatcatgtctcctgaggtctgtgcctcgctgattgtgggctcctacagtgcaggattcctcaattctcttatccacactggctgtatctttagtctgaaattctgcggtgctcatgtcgtcactcacttcttctgtgatgggccacccatcctgtccttgtcttgtgtagacacctcactgtgtgagatcctgctcttcatttttgctggtttcaaccttttgagctgcaccctcaccatcttgatctcctacttcttaattctcaacaccatcctgaaaatgagctcggcccagggcaggtttaaggcattttccacctgtgcatcccacctcactgccatctgcctcttctttggcacaacactttttatgtacctgcgccccaggtccagctactccttgacccaggaccgcacagttgctgtcatctacacagtggtgatcccagtgctgaaccccctcatgtactctttgagaaacaaggatgtgaagaaagctttaataaaggtttggggtaggaaaacaatggaatga

SEQ ID NO: 183 - protein, 314 aa, Homo sapiens
MRGFNKTTVVTQFILVGFSSLGELQLLLFVIFLLLYLTILVANVTIMAVIRFSWTLHTPMYGFLFILSFSESCYTFVIIPQLLVHLLSDTKTISFMACATQLFFFLGFACTNCLLIAVMGYDRYVAICHPLRYTLIINKRLGLELISLSGATGFFIALVATNLICDMRFCGPNRVNHYFCDMAPVIKLACTDTHVKELALFSLSILVIMVPFLLILISYGFIVNTILKIPSAEGKKAFVTCASHLTVVFVHYGCASIIYLRPKSKSASDKDQLVAVTYTVVTPLLNPLVYSLRNKEVKTALKRVLGMPVATKMS

SEQ ID NO: 184 - DNA, 945 bp, Homo sapiens
atgcgaggtttcaacaaaaccactgtggttacacagttcatcctggtgggtttctccagcctgggggagctccagctgctgctttttgtcatctttcttctcctatacttgacaatcctggtggccaatgtgaccatcatggccgttattcgcttcagctggactctccacactcccatgtatggctttctattcatcctttcattttctgagtcctgctacacttttgtcatcatccctcagctgctggtccacctgctctcagacaccaagaccatctccttcatggcctgtgccacccagctgttctttttccttggctttgcttgcaccaactgcctcctcattgctgtgatgggatatgatcgctatgtagcaatttgtcaccctctgaggtacacactcatcataaacaaaaggctggggttggagttgatttctctctcaggagccacaggtttctttattgctttggtggccaccaacctcatttgtgacatgcgtttttgtggccccaacagggttaaccactatttctgtgacatggcacctgttatcaagttagcctgcactgacacccatgtgaaagagctggctttatttagcctcagcatcctggtaattatggtgccttttctgttaattctcatatcctatggcttcatagttaacaccatcctgaagatcccctcagctgagggcaagaaggcctttgtcacctgtgcctcacatctcactgtggtctttgtccactatggctgtgcctctatcatctatctgcggcccaagtccaagtctgcctcagacaaggatcagttggtggcagtgacctacacagtggttactcccttacttaatcctcttgtctacagtctgaggaacaaagaggtaaaaactgcattgaaaagagttcttggaatgcctgtggcaaccaagatgagctaa

SEQ ID NO: 185 - protein, 312 aa, Homo sapiens
MERVNETVVREVIFLGFSSLARLQQLLFVIFLLLYLFTLGTNAIIISTIVLDRALHIPMYFFLAILSCSEICYTFIIVPKMLVDLLSQKKTISFLGCAIQMFSFLFLGCSHSFLLAVMGYDRYIAICNPLRYSVLMGHGVCMGLVAAACACGFTVAQIITSLVFHLPFYSSNQLHHFFCDIAPVLKLASHHNHFSQIVIFMLCTLVLAIPLLLILVSYVHILSAILQFPSTLGRCKAFSTCVSHLIIVTVHYGCASFIYLRPQSNYSSSQDALISVSYTIITPLFNPMIYSLRNKEFKSALCKIVRRTISLL

SEQ ID NO: 186 - DNA, 939 bp, Homo sapiens
atggagcgggtcaatgagactgtggtgagagaggtcatcttcctcggcttctcatccctggccaggctgcagcagctgctctttgttatcttcctgctcctctacctgttcactctgggcaccaatgcaatcatcatttccaccattgtcctggacagggcccttcatatccccatgtacttcttccttgccatcctctcttgctctgagatttgctacaccttcatcattgtacccaagatgctggttgacctgctgtcccagaagaagaccatttctttcctgggctgtgccatccaaatgttttccttcctcttccttggctgctctcactcctttctgctggcagtcatgggttatgatcgttacatagccatctgtaacccactgcgctactcagtgctaatgggacatggggtgtgtatgggactagtggctgctgcctgtgcctgtggcttcactgttgcacagatcatcacatccttggtatttcacctgcctttttattcctccaatcaactacatcacttcttctgtgacattgctcctgtcctcaagctggcatctcaccataaccactttagtcagattgtcatcttcatgctctgtacattggtcctggctatccccttattgttgatcttggtgtcctatgttcacatcctctctgccatacttcagtttccttccacactgggtaggtgcaaagctttttctacctgtgtatctcacctcattattgtcactgtccactatggctgtgcctcctttatctacttaaggcctcagtccaactactcctcaagccaggatgctctaatatcagtatcctacactattataactccattgttcaacccaatgatttatagcttgagaaataaagagttcaaatcagctctttgtaaaattgtgagaagaacaatttccctgttgtaa

SEQ ID NO: 187 - protein, 312 aa, Homo sapiens
MDTGNWSQVAEFIILGFPHLQGVQIYLFLLLLLIYLMTVLGNLLIFLVVCLDSRLHTPMYHFVSILSFSELGYTAATIPKMLANLLSEKKTISFSGCLLQIYFFHSLGATECYLLTAMAYDRYLAICRPLHYPTLMTPTLCAEIAIGCWLGGLAGPVVEISLISRLPFCGPNRIQHVFCDFPPVLSLACTDTSINVLVDFVINSCKILATFLLILCSYVQIICTVLRIPSAAGKRKAISTCASHFTVVLIFYGSILSMYVQLKKSYSLDYDQALAVVYSVLTPFLNPFIYSLRNKEIKEAVRRQLKRIGILA

SEQ ID NO: 188 - DNA, 939 bp, Homo sapiens
atggacacagggaactggagccaggtagcagaattcatcatcttgggcttcccccatctccagggtgtccagatttatctcttcctcttgttgcttctcatttacctcatgactgtgttgggaaacctgctgatattcctggtggtctgcctggactcccggcttcacacacccatgtaccactttgtcagcattctctccttctcagagcttggctatacagctgccaccatccctaagatgctggcaaacttgctcagtgagaaaaagaccatttcattctctgggtgtctcctgcagatctatttctttcactcccttggagcgactgagtgctatctcctgacagctatggcctacgataggtatttagccatctgccggcccctccactacccaaccctcatgaccccaacactttgtgcagagattgccattggctgttggttgggaggcttggctgggccagtagttgaaatttccttgatttcacgcctcccattctgtggccccaatcgcattcagcacgtcttttgtgacttccctcctgtgctgagtttggcttgcactgatacgtctataaatgtcctagtagattttgttataaattcctgcaagatcctagccaccttcctgctgatcctctgctcctatgtgcagatcatctgcacagtgctcagaattccctcagctgccggcaagaggaaggccatctccacgtgtgcctcccacttcactgtggttctcatcttctatgggagcatcctttccatgtatgtgcagctgaagaagagctactcactggactatgaccaggccctggcagtggtctactcagtgctcacacccttcctcaaccccttcatctacagcttgcgcaacaaggagatcaaggaggctgtgaggaggcagctaaagagaattgggatattggcatga

SEQ ID NO: 189 - protein, 319 aa, Homo sapiens
MPVGKLVFNQSEPTEFVFRAFTTATEFQVLLFLLFLLLYLMILCGNTAIIWVVCTHSTLRTPMYFFLSNLSFLELCYTTVVVPLMLSNILGAQKPISLAGCGAQMFFFVTLGSTDCFLLAIMAYDRYVAICHPLHYTLIMTRELCTQMLGGALGLALFPSLQLTALIFTLPFCGHHQEINHFLCDVPPVLRLACADIRVHQAVLYVVSILVLTIPFLLICVSYVFITCAILSIRSAEGRRRAFSTCSFHLTVVLLQYGCCSLVYLRPRSSTSEDEDSQIALVYTFVTPLLNPLLYSLRNKDVKGALRSAIIRKAASDAN

SEQ ID NO: 190 - DNA, 960 bp, Homo sapiens
atgcctgtggggaaacttgtcttcaaccagtctgagcccactgagtttgtgttccgtgcgttcaccacagccactgaattccaggttcttctcttccttctcttcctcctcctctacttgatgatcctctgtggcaacacagccatcatctgggtggtgtgcacacacagcaccctccgcaccccgatgtatttcttcctgtccaacctgtctttcctggaactctgctacaccaccgtggtagtacccttgatgctttccaacattttgggggcccagaagcccatttcgttggctggatgtggggcccaaatgttcttctttgtcaccctcggcagcacggactgtttcctcttggcgatcatggcctatgaccgctatgtggctatctgccacccgctgcactacaccctcatcatgacccgcgagctgtgcacgcagatgctgggtggggccctgggcctggccctcttcccctccctgcagctcaccgccttaatcttcaccctgcccttttgcggccaccaccaggaaatcaaccacttcctctgcgatgtgcctcccgtcctgcgcctggcctgcgctgacatccgcgtgcaccaggctgtcctctatgtcgtgagcatcctcgtgctgaccatccccttcctgctcatctgcgtctcctacgtgttcatcacctgtgccatcctgagcatccgttctgccgagggccgccgccgggccttctccacctgctccttccacctcaccgtggtcctgctgcagtatggctgctgcagcctcgtgtacctgcgtcctcggtccagcacctcagaggatgaggacagccaaatcgcgttggtctacacctttgtcacccccttactcaaccctttgctttacagccttaggaacaaggatgtcaaaggtgctctgaggagtgccattatccgtaaagcagcctctgacgccaactga

SEQ ID NO: 191 - protein, 310 aa, Homo sapiens
MAEMNLTLVTEFLLIAFTEYPEWALPLFLLLLFMYLITVLGNLEMIILILMDHQLHAPMYFLLSHLAFMDVCYSSITVPQMLAVLLEHGAALSYTRCAAQFFLFTFFGSIDCYLLALMAYDRYLAVCQPLLYVTILTQQARLSLVAGAYVAGLISALVRTVSAFTLSFCGTSEIDFIFCDLPPLLKLTCGESYTQEVLIIMFAIFVIPASMVVILVSYLFIIVAIMGIPAGSQAKTFSTCTSHLTAVSLFFGTLIFMYLRGNSDQSSEKNRVVSVLYTEVIPMLNPLIYSLRNKEVKEALRKILNRAKLS

SEQ ID NO: 192 - DNA, 933 bp, Homo sapiens
atggcagagatgaacctcaccttggtgaccgagttcctccttattgcattcactgaatatcctgaatgggcactccctctcttcctcttgttattatttatgtatctcatcaccgtattggggaacttagagatgattattctgatcctcatggatcaccagctccacgctccaatgtatttccttctgagtcacctcgctttcatggacgtctgctactcatctatcactgtcccccagatgctggcagtgctgctggagcatggggcagctttatcttacacacgctgtgctgctcagttctttctgttcaccttctttggttccatcgactgctacctcttggccctcatggcctatgaccgctacttggctgtgtgccagcccctgctttatgtcaccatcctgacacagcaggcccgcttgagtcttgtggctggggcttacgttgctggtctcatcagtgccttggtgcggacagtctcagccttcactctctccttctgtggaaccagtgagattgactttattttctgtgacctccctcctctgttaaagttgacctgtggggagagctacactcaagaagtgctgattattatgtttgccatttttgtcatccctgcttccatggtggtgatcttggtgtcctacctgtttatcatcgtggccatcatggggatccctgctggaagccaggccaagaccttctccacctgcacctcccacctcactgctgtgtcactcttctttggtaccctcatcttcatgtacttgagaggtaactcagatcagtcttcggagaagaatcgggtagtgtctgtgctttacacagaggtcatccccatgttgaatcccctcatctacagcctgaggaacaaggaagtgaaggaggccctgagaaaaattctcaatagagccaagttgtcctaa

SEQ ID NO: 193 - protein, 315 aa, Homo sapiens
MQGLNHTSVSEFILVGFSAFPHLQLMLFLLFLLMYLFTLLGNLLIMATVWSERSLHMPMYLFLCALSITEILYTVAIIPRMLADLLSTQRSIAFLACASQMFFSFSFGFTHSFLLTVMGYDRYVAICHPLRYNVLMSLRGCTCRVGCSWAGGLVMGMVVTSAIFHLAFCGHKEIHHFFCHVPPLLKLACGDDVLVVAKGVGLVCITALLGCFLLILLSYAFIVAAILKIPSAEGRNKAFSTCASHLTVVVVHYGFASVIYLKPKGPQSPEGDTLMGITYTVLTPFLSPIIFSLRNKELKVAMKKTCFTKLFPQNC

SEQ ID NO: 194 - DNA, 948 bp, Homo sapiens
atgcaggggctaaaccacacctccgtgtctgaattcatcctcgttggcttctctgccttcccccacctccagctgatgctcttcctgctgttcctgctgatgtacctgttcacgctgctgggcaacctgctcatcatggccactgtctggagcgagcgcagcctccacatgcccatgtacctcttcctgtgtgccctctccatcaccgagatcctctacaccgtggccatcatcccgcgcatgctggccgacctgctgtccacccagcgctccatcgccttcctggcctgtgccagtcagatgttcttctccttcagcttcggcttcacccactccttcctgctcactgtcatgggctacgaccgctacgtggccatctgccaccccctgcgttacaacgtgctcatgagcctgcggggctgcacctgccgggtgggctgctcctgggctggtggcttggtcatggggatggtggtgacctcggccattttccacctcgccttctgtggacacaaggagatccaccatttcttctgccacgtgccacctctgttgaagttggcctgtggagatgatgtgctggtggtggccaaaggcgtgggcttggtgtgtatcacggccctgctgggctgttttctcctcatcctcctctcctatgccttcatcgtggccgccatcttgaagatcccttctgctgaaggtcggaacaaggccttctccacctgtgcctctcacctcactgtggtggtcgtgcactatggctttgcctccgtcatttacctgaagcccaaaggtccccagtctccggaaggagacaccttgatgggcatcacctacacggtcctcacacccttcctcagccccatcatcttcagcctcaggaacaaggagctgaaggtcgccatgaagaagacttgcttcaccaaactctttccacagaactgctga

SEQ ID NO: 195 - protein, 313 aa, Homo sapiens
METANYTKVTEFVLTGLSQTPEVQLVLFVIFLSFYLFILPGNILIICTISLDPHLTSPMYFLLANLAFLDIWYSSITAPEMLIDFFVERKIISFDGCIAQLFFLHFAGASEMFLLTVMAFDLYTAICRPLHYATIMNQRLCCILVALSWRGGFIHSIIQVALIVRLPFCGPNELDSYFCDITQVVRIACANTFPEELVMICSSGLISVVCLIALLMSYAFLLALFKKLSGSGENTNRAMSTCYSHITIVVLMFGPSIYIYARPFDSFSLDKVVSVFNTLIFPLRNPIIYTLRNKEVKAAMRKLVTKYILCKEK

SEQ ID NO: 196 - DNA, 942 bp, Homo sapiens
atggaaactgcaaattacaccaaggtgacagaatttgttctcactggcctatcccagactccagaggtccaactagtcctatttgttatatttctatccttctatttgttcatcctaccaggaaatatccttatcatttgcaccatcagtctagaccctcatctgacctctcctatgtatttcctgttggctaatctggccttccttgatatttggtactcttccattacagcccctgaaatgctcatagacttctttgtggagaggaagataatttcttttgatggatgcattgcacagctcttcttcttacactttgctggggcttcggagatgttcttgctcacagtgatggcctttgacctctacactgctatctgccgacccctccactatgctaccatcatgaatcaacgtctctgctgtatcctggtggctctctcctggagggggggcttcattcattctatcatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttgattgctctgttaatgtcctatgccttccttctggccttgttcaagaaactttcaggctcaggtgagaataccaacagggccatgtccacctgctattcccacattaccattgtggtgctaatgtttgggccatccatctacatttatgctcgcccatttgactcgttttccctagataaagtggtgtctgtgttcaatactttaatattccctttacgtaatcccattatttacacattgagaaacaaggaagtaaaggcagccatgaggaagttggtcaccaaatatattttgtgtaaagagaagtga

SEQ ID NO: 197 - protein, 316 aa, Homo sapiens
MELWNFTLGSGFILVGILNDSGSPELLCATITILYLLALISNGLLLLAITMEARLHMPMYLLLGQLSLMDLLFTSVVTPKALADFLRRENTISFGGCALQMFLALTMGGAEDLLLAFMAYDRYVAICHPLTYMTLMSSRACWLMVATSWILASLSALIYTVYTMHYPFCRAQEIRHLLCEIPHLLKVACADTSRYELMVYVMGVTFLIPSLAAILASYTQILLTVLHMPSNEGRKKALVTCSSHLTVVGMFYGAATFMYVLPSSFHSTRQDNIISVFYTIVTPALNPLIYSLRNKEVMRALRRVLGKYMLPAHSTL

SEQ ID NO: 198 - DNA, 951 bp, Homo sapiens
atggagctctggaacttcaccttgggaagtggcttcattttggtggggattctgaatgacagtgggtctcctgaactgctctgtgctacaattacaatcctatacttgttggccctgatcagcaatggcctactgctcctggctatcaccatggaagcccggctccacatgcccatgtacctcctgcttgggcagctctctctcatggacctcctgttcacatctgttgtcactcccaaggcccttgcggactttctgcgcagagaaaacaccatctcctttggaggctgtgcccttcagatgttcctggcactgacaatgggtggtgctgaggacctcctactggccttcatggcctatgacaggtatgtggccatttgtcatcctctgacatacatgaccctcatgagctcaagagcctgctggctcatggtggccacgtcctggatcctggcatccctaagtgccctaatatataccgtgtataccatgcactatcccttctgcagggcccaggagatcaggcatcttctctgtgagatcccacacttgctgaaggtggcctgtgctgatacctccagatatgagctcatggtatatgtgatgggtgtgaccttcctgattccctctcttgctgctatactggcctcctatacacaaattctactcactgtgctccatatgccatcaaatgaggggaggaagaaagcccttgtcacctgctcttcccacctgactgtggttgggatgttctatggagctgccacattcatgtatgtcttgcccagttccttccacagcaccagacaagacaacatcatctctgttttctacacaattgtcactccagccctgaatccactcatctacagcctgaggaataaggaggtcatgcgggccttgaggagggtcctgggaaaatacatgctgccagcacactccacgctctag

SEQ ID NO: 199 - protein, 330 aa, Homo sapiens
MCSFFLCQTGKQAKISMGEENQTFVSKFIFLGLSQDLQTQILLFILFLIIYLLTVLGNQLIIILIFLDSRLHTPMYFFLRNLSFADLCFSTSIVPQVLVHFLVKRKTISFYGCMTQIIVFLLVGCTECALLAVMSYDRYVAVCKPLYYSTIMTQRVCLWLSFRSWASGALVSLVDTSFTFHLPYWGQNIINHYFCEPPALLKLASIDTYSTEMAIFSMGVVILLAPVSLILGSYWNIISTVIQMQSGEGRLKAFSTCGSHLIVVVLFYGSGIFTYMRPNSKTTKELDKMISVFYTAVTPMLNPIIYSLRNKDVKGALRKLVGRKCFSHRQ

SEQ ID NO: 200 - DNA, 993 bp, Homo sapiens
atgtgttcttttttcttgtgccaaacaggtaaacaggcaaaaatatcaatgggagaagaaaaccaaacctttgtgtccaagtttatcttcctgggtctttcacaggacttgcagacccagatcctgctatttatccttttcctcatcatttatctgctgaccgtgcttggaaaccagctcatcatcattctcatcttcctggattctcgccttcacactcccatgtatttttttcttagaaatctctcctttgcagatctctgtttctctactagcattgtccctcaagtgttggttcacttcttggtaaagaggaaaaccatttctttttatgggtgtatgacacagataattgtctttcttctggttgggtgtacagagtgtgcgctgctggcagtgatgtcctatgaccggtatgtggctgtctgcaagcccctgtactactctaccatcatgacacaacgggtgtgtctctggctgtccttcaggtcctgggccagtggggcactagtgtctttagtagataccagctttactttccatcttccctactggggacagaatataatcaatcactacttttgtgaacctcctgccctcctgaagctggcttccatagacacttacagcacagaaatggccatcttttcaatgggcgtggtaatcctcctggcccctgtctccctgattcttggttcttattggaatattatctccactgttatccagatgcagtctggggaagggagactcaaggctttttccacctgtggctcccatcttattgttgttgtcctcttctatgggtcaggaatattcacctacatgcgaccaaactccaagactacaaaagaactggataaaatgatatctgtgttctatacagcggtgactccaatgttgaaccccataatttatagcttgaggaacaaagatgtcaaaggggctctcaggaaactagttgggagaaagtgcttctctcataggcagtga

SEQ ID NO: 201 - protein, 317 aa, Homo sapiens
MLRNGSIVTEFILVGFQQSSTSTRALLFALFLALYSLTMAMNGLIIFITSWTDPKLNSPMYFFLGHLSLLDVCFITTTIPQMLIHLVVRDHIVSFVCCMTQMYFVFCVGVAECILLAFMAYDRYVAICYPLNYVPIISQKVCVRLVGTAWFFGLINGIFLEYISFREPFRRDNHIESFFCEAPIVIGLSCGDPQFSLWAIFADAIVVILSPMVLTVTSYVHILATILSKASSSGRGKTFSTCASHLTVVIFLYTSAMFSYMNPHSTHGPDKDKPFSLLYTIITPMCNPIIYSFRNKEIKEAMVRALGRTRLAQPQSV

SEQ ID NO: 202 - DNA, 954 bp, Homo sapiens
atgctaaggaatggcagcatagtgacggaatttatcctcgtgggctttcagcagagctccacttccacacgagcattgctctttgccctcttcttggccctctacagcctcaccatggccatgaatggcctcatcatctttatcacctcctggacagaccccaagctcaacagccccatgtacttcttcctcggccatctgtctctcctggatgtctgcttcatcaccactaccatcccacagatgttgatccacctcgtggtcagggaccacattgtctcctttgtatgttgcatgacccagatgtactttgtcttctgtgttggtgtggccgagtgcatcctcttggctttcatggcctatgaccgttatgttgctatctgctacccacttaactatgtcccgatcataagccagaaggtctgtgtcaggcttgtgggaactgcctggttctttgggctgatcaatggcatctttctcgagtatatttcattccgagagcccttccgcagagacaaccacatagaaagcttcttctgtgaggcccccatagtgattggcctctcttgtggggaccctcagtttagtctgtgggcaatctttgccgatgccatcgtggtaattctcagccccatggtgctcactgtcacttcctatgtgcacatcctggccaccatcctcagcaaagcctcctcctcaggtcgggggaagactttctctacttgtgcctctcacctgactgtggtcatctttctctacacttcagctatgttctcttacatgaacccccacagcacacatgggcctgacaaagacaaacctttctccctcctgtacaccatcattacccccatgtgcaaccccatcatttatagtttccgcaacaaggaaattaaggaggccatggtgagggcacttggaagaaccaggctggcccagccacagtctgtctag

SEQ ID NO: 203 - protein, 316 aa, Homo sapiens
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 204 - DNA, 951 bp, Homo sapiens
atgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttatttctgggcaacttggccttcctggatgcatcctactccttcattgtggctcccaggatgttggtggacttcctctctgagaaaaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctaatggtcttcaacagtggcctgatgacactcctgtgctttctggggcttctggcttcctatgcagtcatcctctgccatgttcgtagggcagcttctgaagggaagaacaaggccatgtccacgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactga

SEQ ID NO: 205 - protein, 338 aa, Homo sapiens
MCYIYLIFKEWTLIFYFSLLLFLQITPAIMANLTIVTEFILMGFSTNKNMCILHSILFLLIYLCALMGNVLIIMITTLDHHLHTPVYFFLKNLSFLDLCLISVTAPKSIANSLIHNNSISFLGCVSQVFLLLSSASAELLLLTVMSFDRYTAICHPLHYDVIMDRSTCVQRATVSWLYGGLIAVMHTAGTFSLSYCGSNMVHQFFCDIPQLLAISCSENLIREIALILINVVLDFCCFIVIIITYVHVFSTVKKIPSTEGQSKAYSICLPHLLVVLFLSTGFIAYLKPASESPSILDAVISVFYTMLPPTFNPIIYSLRNKAIKVALGMLIKGKLTKK

SEQ ID NO: 206 - DNA, 1017 bp, Homo sapiens
atgtgttatatatatttaatatttaaagagtggacattgatattttacttcagtcttctccttttcctgcagattactcctgcaataatggcaaatctcacaatcgtgactgaatttatccttatggggttttctaccaataaaaatatgtgcattttgcattcgattctcttcttgttgatttatttgtgtgccctgatggggaatgtcctcattatcatgatcacaactttggaccatcatctccacacccccgtgtatttcttcttgaagaatctatctttcttggatctctgccttatttcagtcacggctcccaaatctatcgccaattctttgatacacaacaactccatttcattccttggctgtgtttcccaggtctttttgttgctttcttcagcatctgcagagctgctcctcctcacggtgatgtcctttgaccgctatactgctatatgtcaccctctgcactatgatgtcatcatggacaggagcacctgtgtccaaagagccactgtgtcttggctgtatgggggtctgattgctgtgatgcacacagctggcaccttctccttatcctactgtgggtccaacatggtccatcagttcttctgtgacattccccagttattagctatttcttgctcagaaaatttaataagagaaattgcactcatccttattaatgtagttttggatttctgctgttttattgtcatcatcattacctatgtccacgtcttctctacagtcaagaagatcccttccacagaaggccagtcaaaagcctactctatttgccttccacacttgctggttgtgttatttctttccactggattcattgcttatctgaagccagcttcagagtctccttctattttggatgctgtaatttctgtgttctacactatgctgcccccaacctttaatcccattatatacagtttgagaaacaaggccataaaggtggctctggggatgttgataaagggaaagctcaccaaaaagtaa

SEQ ID NO: 207 - protein, 342 aa, Homo sapiens
MKFWHGFSSHLNPMFSSFLLYLSLPWINTTIQAWLNLCSLALPVWAMSGAGFLSCCYWHTCSPSVVTCSSSQSSDWMQLCTHLCTTLSVFFPSWSCGIQLPLSLRCCLIFSVRRKPFLLQDASFRPTSSTPWGACECYLLTAMAYDRYLAICRPLHYPIIMTTTLCAKMAAACWTCGFLCPISEVILASQLPFCAYNEIQHIFCDFPPLLSLACKDTSANILVDFAINAFIILITFFFIMISYARIIGAVLKIKTASGRKKAFSTCASHLAVVLIFFGSIIFMYVRLKKSYSLTLDRTLAIVYSVLTPMVNPIIYSLRNKEIIKAIKRTIFQKGDKASLAHL

SEQ ID NO: 208 - DNA, 1053 bp, Homo sapiens; identical to SEQ ID NO: 98

SEQ ID NO: 209 - protein, 309 aa, Homo sapiens
MERINHTSSVSEFILLGLSSRPEDQKTLFVLFLIVYLVTITGNLLIILAIRFNPHLQTPMYFFLSFLSLTDICFTTSVVPKMLMNFLSEKKTISYAGCLTQMYFLYALGNSDSCLLAVMAFDRYVAVCDPFHYVTTMSHHHCVLLVAFSCSFPHLHSLLHTLLLNRLTFCDSNVIHHFLCDLSPVLKLSCSSIFVNEIVQMTEAPIVLVTRFLCIAFSYIRILTTVLKIPSTSGKRKAFSTCGFYLTVVTLFYGSIFCVYLQPPSTYAVKDHVATIVYTVLSSMLNPFIYSLRNKDLKQGLRKLMSKRS

SEQ ID NO: 210 - DNA, 930 bp, Homo sapiens
atggaaagaatcaaccacaccagcagtgtctccgagtttatcctcctgggactctcctcccggcctgaggaccaaaagacactctttgttctcttcctcatcgtgtacctggtcaccataacagggaacctgctcatcatcctggccattcgcttcaacccccatcttcagacccctatgtatttcttcttgagttttctgtctctcactgatatttgctttacaacaagcgttgtccccaagatgctgatgaacttcctgtcagaaaagaagaccatctcctatgctgggtgtctgacacagatgtattttctctatgccttgggcaacagtgacagctgccttctggcagtcatggcctttgaccgctatgtggccgtctgtgaccctttccactatgtcaccaccatgagccaccaccactgtgtcctgctggtggccttctcctgctcatttcctcacctccactcactcctgcacacacttctgctgaatcgtctcaccttctgtgactccaatgttatccaccactttctctgtgacctcagccctgtgctgaaattgtcctgctcttccatatttgtcaatgaaattgtgcagatgacagaagcacctattgttttggtgactcgttttctctgcattgctttctcttatatacgaatcctcactacagttctcaagattccctctacttctgggaaacgcaaagccttctccacctgtggtttttacctcaccgtggtgacgctcttttatggaagcatcttctgtgtctatttacagcccccatccacctacgctgtcaaggaccacgtggcaacaattgtttacacagttttgtcatccatgctcaatccttttatctacagcctgagaaacaaagacctgaaacagggcctgaggaagcttatgagcaagagatcctag

SEQ ID NO: 211 - protein, 330 aa, Homo sapiens
MEGFYLRRSHELQGMGKPGRVNQTTVSDFLLLGLSEWPEEQPLLFGIFLGMYLVTMVGNLLIILAISSDPHLHTPMYFFLANLSLTDACFTSASIPKMLANIHTQSQIISYSGCLAQLYFLLMFGGLDNCLLAVMAYDRYVAICQPLHYSTSMSPQLCALMLGVCWVLTNCPALMHTLLLTRVAFCAQKAIPHFYCDPSALLKLACSDTHVNELMIITMGLLFLTVPLLLIVFSYVRIFWAVFVISSPGGRWKAFSTCGSHLTVVLLFYGSLMGVYLLPPSTYSTERESRAAVLYMVIIPTLNPFIYSLRNRDMKEALGKLFVSGKTFFL

SEQ ID NO: 212 - DNA, 993 bp, Homo sapiens
atggaaggtttttatctgcgcagatcacacgaactacaagggatgggaaaaccaggcagagtgaaccaaaccactgtttcagacttcctccttctaggactctctgagtggccagaggagcagcctcttctgtttggcatcttccttggcatgtacctggtcaccatggtggggaacctgctcattatcctggccatcagctctgacccacacctccatactcccatgtacttctttctggccaacctgtcattaactgatgcctgtttcacttctgcctccatccccaaaatgctggccaacattcatacccagagtcagatcatctcgtattctgggtgtcttgcacagctatatttcctccttatgtttggtggccttgacaactgcctgctggctgtgatggcatatgaccgctatgtggccatctgccaaccactccattacagcacatctatgagtccccagctctgtgcactaatgctgggtgtgtgctgggtgctaaccaactgtcctgccctgatgcacacactgttgctgacccgcgtggctttctgtgcccagaaagccatccctcatttctattgtgatcctagtgctctcctgaagcttgcctgctcagatacccatgtaaacgagctgatgatcatcaccatgggcttgctgttcctcactgttcccctcctgctgatcgtcttctcctatgtccgcattttctgggctgtgtttgtcatctcatctcctggagggagatggaaggccttctctacctgtggttctcatctcacggtggttctgctcttctatgggtctcttatgggtgtgtatttacttcctccatcaacttactctacagagagggaaagtagggctgctgttctctatatggtgattattcccacgctaaacccattcatttatagcttgaggaacagagacatgaaggaggctttgggtaaactttttgtcagtggaaaaacattctttttatga

SEQ ID NO: 213 - protein, 312 aa, Homo sapiens
MDEANHSVVSEFVFLGLSDSRKIQLLLFLFFSVFYVSSLMGNLLIVLTVTSDPRLQSPMYFLLANLSIINLVFCSSTAPKMIYDLFRKHKTISFGGCVVQIFFIHAVGGTEMVLLIAMAFDRYVAICKPLHYLTIMNPQRCILFLVISWIIGIIHSVIQLAFVVDLLFCGPNELDSFFCDLPRFIKLACIETYTLGFMVTANSGFISLASFLILIISYIFILVTVQKKSSGGIFKAFSMLSAHVIVVVLVFGPLIFFYIFPFPTSHLDKFLAIFDAVITPVLNPVIYTFRNKEMMVAMRRRCSQFVNYSKIF

SEQ ID NO: 214 - DNA, 939 bp, Homo sapiens
atggatgaagccaatcactctgtggtctctgagtttgtgttcctgggactctctgactcgcggaagatccagctcctcctcttcctctttttctcagtgttctatgtatcaagcctgatgggaaatctcctcattgtgctaactgtgacctctgaccctcgtttacagtcccccatgtacttcctgctggccaacctttccatcatcaatttggtattttgttcctccacagctcccaagatgatttatgaccttttcaggaagcacaagaccatctcttttgggggctgtgtagttcagatcttctttatccatgcagttgggggaactgagatggtgctgctcatagccatggcttttgaccgatatgtggccatatgtaagcctctccactacctgaccatcatgaacccacaaaggtgcattttgtttttagtcatttcctggattataggtattattcactcagtgattcagttggcttttgttgtagacctgctgttctgtggccctaatgaattagatagtttcttttgtgatcttcctcgatttatcaaactggcttgcatagagacctacacattgggattcatggttactgccaatagtggatttatttctctggcttcttttttaattctcataatctcttacatctttattttggtgactgttcagaaaaaatcttcaggtggtatattcaaggctttctctatgctgtcagctcatgtcattgtggtggttttggtctttgggccattaatctttttctatatttttccatttcccacatcacatcttgataaattccttgccatctttgatgcagttatcactcccgttttgaatccagtcatctatacttttagaaataaagagatgatggtggcaatgagaagacgatgctctcagtttgtgaattacagtaaaatcttttaa

SEQ ID NO: 215 - protein, 357 aa, Homo sapiens [sequence omitted]

SEQ ID NO: 216 - DNA, 1074 bp, Homo sapiens
atgaataacactattgtatttgtcataaaaatacaaatagaaaaaagtgacttgaaatatagagccatttcattgcaagaaatctcaaagatttcccttcttttctgggtccttctcttggtcatttctagacttttactagccatgacactaggaaacagcactgaagtcactgaattctatcttctgggatttggtgcccagcatgagttttggtgtatcctcttcattgtattccttctcatctatgtgacctccataatgggtaatagtggaataatcttactcatcaacacagattccagatttcaaacactcacgtacttttttctacaacatttggcttttgttgatatctgttacacttctgctatcactcccaagatgctccaaagcttcacagaagaaaagaatttgatattatttcagggctgtgtgatacaattcttagtttatgcaacatttgcaaccagtgactgttatctcctggctatgatggcagtggatccttatgttgccatctgtaagccccttcactatactgtaatcatgtcccgaacagtctgcatccgtttggtagctggttcatacatcatgggctcaataaatgcctctgtacaaacaggttttacatgttcactgtccttctgcaagtccaatagcatcaatcactttttctgtgatgttccccctattcttgctctttcatgctccaatgttgacatcaacatcatgctacttgttgtctttgtgggatctaacttgatattcactgggttggtcgtcatcttttcctacatctacatcatggccaccatcctgaaaatgtcttctagtgcaggaaggaaaaaatccttctcaacatgtgcttcccacctgaccgcagtcaccattttctatgggacactctcttacatgtatttgcagtctcattctaataattcccaggaaaatatgaaagtggcctttatattttatggcacagttattcccatgttaaatcctttaatctatagcttgagaaataaggaagtaaaagaagctttaaaagtgatagggaaaaagttattttaa

SEQ ID NO: 217 - protein, 324 aa, Homo sapiens
MNHMSASLKISNSSKFQVSEFILLGFPGIHSWQHWLSLPLALLYLSALAANTLILIIIWQNPSLQQPMYIFLGILCMVDMGLATTIIPKILAIFWFDAKVISLPECFAQIYAIHFFVGMESGILLCMAFDRYVAICHPLRYPSIVTSSLILKATLFMVLRNGLFVTPVPVLAAQRDYCSKNEIEHCLCSNLGVTSLACDDRRPNSICQLVLAWLGMGSDLSLIILSYILILYSVLRLNSAEAAAKALSTCSSHLTLILFFYTIVVVISVTHLTEMKATLIPVLLNVLHNIIPPSLNPTVYALQTKELRAAFQKVLFALTKEIRS

SEQ ID NO: 218 - DNA, 975 bp, Homo sapiens
atgaatcatatgtctgcatctctcaaaatctccaatagctccaaattccaggtctctgagttcatcctgctgggattcccgggcattcacagctggcaacactggctatctctgcccctggcactactgtatctctcagcacttgctgcaaacaccctcatcctcatcatcatctggcagaacccttctttacagcagcccatgtatattttccttggcatcctctgtatggtagacatgggtctggccactactatcatccctaagatcctggccatcttctggtttgatgccaaggttattagcctccctgagtgctttgctcagatttatgccattcacttctttgtgggcatggagtctggtatcctactctgcatggcttttgatagatatgtggctatttgtcaccctcttcgctatccatcaattgtcaccagttccttaatcttaaaagctaccctgttcatggtgctgagaaatggcttatttgtcactccagtgcctgtgcttgcagcacagcgtgattattgctccaagaatgaaattgaacactgcctgtgctctaaccttggggtcacaagcctggcttgtgatgacaggaggccaaacagcatttgccagttggttctggcatggcttggaatggggagtgatctaagtcttattatactgtcatatattttgattctgtactctgtacttagactgaactcagctgaagctgcagccaaggccctgagcacttgtagttcacatctcaccctcatccttttcttttacactattgttgtagtgatttcagtgactcatctgacagagatgaaggctactttgattccagttctacttaatgtgttgcacaacatcatccccccttccctcaaccctacagtttatgcacttcagaccaaagaacttagggcagccttccaaaaggtgctgtttgcccttacaaaagaaataagatcttag

SEQ ID NO: 219 - protein, 324 aa, Homo sapiens
MPLFNSLCWFPTIHVTPPSFILNGIPGLERVHVWISLPLCTMYIIFLVGNLGLVYLIYYEESLHHPMYFFFGHALSLIDLLTCTTTLPNALCIFWFSLKEINFNACLAQMFFVHGFTGVESGVLMLMALDRYIAICYPLRYATTLTNPIIAKAELATFLRGVLLMIPFPFLVKRLPFCQSNIISHTYCDHMSVVKLSCASIKVNVIYGLMVALLIGVFDICCISLSYTLILKAAISLSSSDARQKAFSTCTAHISAIIITYVPAFFTFFAHRFGGHTIPPSLHIIVANLYLLLPPTLNPIVYGVKTKQIRKSVIKFFQGDKGAG

SEQ ID NO: 220 - DNA, 975 bp, Homo sapiens
atgcctctatttaattcattatgctggtttccaacaattcatgtgactcctccatcttttattcttaatggaatacctggtctggaaagagtacatgtatggatctccctcccactctgcacaatgtacatcatcttccttgtggggaatcttggtcttgtgtacctcatttattatgaggagtccttacatcatccgatgtattttttttttggccatgctctctccctcattgacctccttacctgcaccaccactctacccaatgcactctgcatcttctggttcagtctcaaagaaattaacttcaatgcttgcttggcccagatgttctttgttcatgggttcacaggtgtggagtctggggtgctcatgctcatggctctagaccgctatatagccatttgctaccctttgcgttatgctaccacactcaccaaccctatcattgccaaggctgagcttgccaccttcctgaggggtgtattgctgatgattcctttcccattcttggttaagcgtttgcctttctgccaaagcaatattatctcccatacgtactgcgaccacatgtctgtagtaaagctatcttgtgccagcatcaaggtcaatgtaatctatggtctaatggttgctctcctgattggagtgtttgacatttgttgtatatctttgtcttacactttgatcctcaaggcagcgatcagcctctcttcatcagatgctcggcagaaggctttcagcacctgcactgcccatatatctgccatcatcatcacctatgttccagcattcttcactttctttgcccaccgttttgggggacacacaattcccccttctcttcacatcattgtggctaatctttatcttcttcttcccccaactctaaaccctattgtttatggagtaaagacaaaacagatacgcaagagtgtcataaagttcttccagggtgataagggtgcaggttga

SEQ ID NO: 221 - protein, 317 aa, Homo sapiens
MQPYTKNWTQVTEFVMMGFAGIHEAHLLFFILFLTMYLFTLVENLAIILVVGLDHRLRRPMYFFLTHLSCLEIWYTSVTVPKMLAGFIGVDGGKNISYAGCLSQLFIFTFLGATECFLLAAMAYDRYVAICMPLHYGAFVSWGTCIRLAAACWLVGFLTPILPIYLLSQLTFCGPNVIDHFSCDASPLLALSCSDVTWKETVDFLVSLAVLLASSMVIAVSYGNIVWTLLHIRSAAERWKAFSTCAAHLTVVSLFYGTLFFMYVQTKVTSSINFNKVVSVFYSVVTPMLNPLIYSLRNKEVKGALGRVFSLNFWKGQ

SEQ ID NO: 222 - DNA, 954 bp, Homo sapiens
atgcaaccatataccaaaaactggacccaggtaactgaatttgtcatgatgggctttgctggcatccatgaagcacacctcctcttcttcatactcttcctcaccatgtacctgttcaccttggtggagaatttggccatcattttagtggtgggtttggaccaccgactacggagacccatgtatttcttcctgacacacttgtcctgccttgaaatctggtacacttctgttacagtgcccaagatgctggctggttttattggggtggatggtggcaagaatatctcttatgctggttgcctatcccagctcttcatcttcacctttcttggggcaactgagtgtttcctactggctgccatggcctatgatcgttatgtggccatttgtatgcctctccactatggggcttttgtgtcctggggcacctgcatccgtctggcagctgcctgttggctggtaggtttcctcacacccatcttgccaatctacctcttgtctcagctaacattttgtggcccaaatgtcattgaccatttctcctgtgatgcctcacccttgctagccttgtcgtgctcagatgtcacttggaaggagactgtggatttcctggtgtctctggctgtgctactggcctcctctatggtcattgctgtgtcctatggcaacatcgtctggacactgctgcacatccgctcagctgctgagcgctggaaggccttctctacctgtgcagctcacctgactgtggtgagcctcttctatggcactcttttctttatgtatgtccagaccaaggtgacctcctccatcaacttcaacaaggtggtatctgtcttctactctgttgtcacgcccatgctcaatcctctcatctacagtcttaggaacaaggaagtgaagggagctctgggtcgagtcttttctctcaacttttggaagggacagtga

SEQ ID NO: 223 - protein, 309 aa, Homo sapiens
MKRKNFTEVSEFIFLGFSSFGKHQITLFVVFLTVYILTLVANIIIVTIICIDHHLHTPMYFFLSMLASSETVYTLVIVPRMLLSLIFHNQPISLAGCATQMFFFVILATNNCFLLTAMGYDRYVAICRPLRYTVIMSKGLCAQLVCGSFGIGLTMAVLHVTAMFNLPFCGTVVDHFFCDIYPVMKLSCIDTTINEIINYGVSSFVIFVPIGLIFISYVLVISSILQIASAEGRKKTFATCVSHLTVVIVHCGCASIAYLKPKSESSIEKDLVLSVTYTIITPLLNPVVYSLRNKEVKDALCRVVGRNIS

SEQ ID NO: 224 - DNA, 930 bp, Homo sapiens
atgaagagaaagaacttcacagaagtgtcagaattcattttcttgggattttctagctttggaaagcatcagataaccctctttgtggttttcctaactgtctacattttaactctggttgctaacatcatcattgtgactatcatctgcattgaccatcatctccacactcccatgtatttcttcctaagcatgctggctagttcagagacggtgtacacactggtcattgtgccacgaatgcttttgagcctcatttttcataaccaacctatctccttggcaggctgtgctacacaaatgttcttttttgttatcttggccactaataattgcttcctgcttactgcaatggggtatgaccgctatgtggccatctgcagacccctgagatacactgtcatcatgagcaagggactatgtgcccagctggtgtgtgggtcctttggcattggtctgactatggcagttctccatgtgacagccatgttcaatttgccgttctgtggcacagtggtagaccacttcttttgtgacatttacccagtcatgaaactttcttgcattgataccactatcaatgagataataaattatggtgtaagttcatttgtgatttttgtgcccataggcctgatatttatctcctatgtccttgtcatctcttccatccttcaaattgcctcagctgagggccggaagaagacctttgccacctgtgtctcccacctcactgtggttattgtccactgtggctgtgcctccattgcctacctcaagccgaagtcagaaagttcaatagaaaaagaccttgttctctcagtgacgtacaccatcatcactcccttgctgaaccctgttgtttacagtctgagaaacaaggaggtaaaggatgccctatgcagagttgtgggcagaaatatttcttaa

SEQ ID NO: 225 - protein, 318 aa, Homo sapiens
MEWENQTILVEFFLKGHSVHPRLELLFFVLIFIMYVVILLGNGTLILISILDPHLHTPMYFFLGNLSFLDICYTTTSIPSTLVSFLSERKTISFSGCAVQMFLGLAMGTTECVLLGMMAFDRYVAICNPLRYPIIMSKNAYVPMAVGSWFAGIVNSAVQTTFVVQLPFCRKNVINHFSCEILAVMKLACADISGNEFLMLVATILFTLMPLLLIVISYSLIISSILKIHSSEGRSKAFSTCSAHLTVVIIFYGTILFMYMKPKSKETLNSDDLDATDKIISMFYGVMTPMMNPLIYSLRNKDVKEAVKHLPNRRFFSK

SEQ ID NO: 226 - DNA, 957 bp, Homo sapiens
atggaatgggaaaaccaaaccattctggtggaattttttctgaagggacattctgttcacccaaggcttgagttactcttttttgtgctaatcttcataatgtatgtggtcatccttctggggaatggtactctcattttaatcagcatcttggaccctcaccttcacacccctatgtacttctttctggggaacctctccttcttggacatctgctacaccaccacctctattccctccacactagtgagcttcctttcagaaagaaagaccatttccttttctggctgtgcagtgcagatgttccttggcttggccatggggacaacagagtgtgtgcttctgggcatgatggcctttgaccgctatgtggctatctgcaaccctctgagatatcccatcatcatgagcaagaatgcctatgtacccatggctgttgggtcctggtttgcagggattgtcaactctgcagtacaaactacatttgtagtacaattgcctttctgcaggaagaatgtcatcaatcatttctcatgtgaaattctagctgtcatgaagttggcctgtgctgacatctcaggcaatgagttcctcatgcttgtggccacaatattgttcacattgatgccactgctcttgatagttatctcttactcattaatcatttccagcatcctcaagattcactcctctgaggggagaagcaaagctttctctacctgctcagcccatctgactgtggtcataatattctatgggaccatcctcttcatgtatatgaagcccaagtctaaagagacacttaattcagatgacttggatgctaccgacaaaattatatccatgttctatggggtgatgactcccatgatgaatcctttaatctacagtcttagaaacaaggatgtgaaagaggcagtaaaacacctaccgaacagaaggttctttagcaagtga

SEQ ID NO: 227 - protein, 346 aa, Homo sapiens
MYRFTDFDVSNISIYLNHVLFYTTQQAGDLEHMETRNYSAMTEFFLVGLSQYPELQLFLFLLCLIMYMIILLGNSLLIIITILDSRLHTPMYFFLGNLSFLDICYTSSSIPPMLIIFMSERKSISFIGCALQMVVSLGLGSTECVLLAVMAYDHYVAICNPLRYSIIMNGVLYVQMAAWSWIIGCLTSLLQTVLTMMLPFCGNNVIDHITCEILALLKLVCSDITINVLIMTVTNIVSLVILLLLIFISYVFILSSILRINCAEGRKKAFSTCSAHSIVVILFYGSALFMYMKPKSKNTNTSDEIIGLSYGVVSPMLNPIIYSLRNKEVKEAVKKVLSRHLHLLKM

SEQ ID NO: 228 - DNA, 1041 bp, Homo sapiens
atgtacagatttacagattttgatgtatcaaacatttcaatttacctgaatcatgtccttttctatactacccagcaggcaggtgacctagaacacatggagacaagaaattactctgccatgactgaattctttctggtggggctttcccaatatccagagctccagctttttctgttcctgctctgcctcatcatgtacatgataatcctcctgggaaatagcctcctcattatcatcaccatcttggattctcgcctccatactcccatgtatttctttcttggaaacctctcattcttggacatctgttacacatcctcatccattcctccaatgcttattatatttatgtctgagagaaaatccatctccttcattggctgtgctctgcagatggttgtgtcccttggcttgggctccactgagtgtgtcctcctggctgtgatggcctatgaccactatgtggccatctgcaacccactgaggtactccatcatcatgaacggagtgctgtatgtgcaaatggctgcatggtcctggatcataggctgtctgacctccctattgcaaacagttctgacaatgatgttgcctttctgtgggaataatgtcattgatcatattacctgtgaaattttggcccttctaaaacttgtttgttcagatatcaccatcaatgtgcttatcatgacagtgacaaatattgtttcactggtgattcttctactgttaattttcatctcctatgtgtttattctctcttccatcctgagaattaattgtgctgagggaagaaagaaagccttctctacctgttcagcgcactcgattgtggtcatcttattctacggttcagccctttttatgtacatgaaacccaagtcaaagaacactaatacatctgatgagattattgggctgtcttatggagtggtaagcccaatgttaaatcccatcatctatagcctcaggaataaagaggtcaaagaggctgtaaagaaagtcctgagcagacatctgcatttattgaaaatgtga

SEQ ID NO: 229 - protein, 307 aa, Homo sapiens
MNHSVVTEFIILGLTKKPELQGIIFLFFLIVYLVAFLGNMLIIIAKIYNNTLHTPMYVFLLTLAVVDIICTTSIIPKMLGTMLTSENTISYAGCMSQLFLFTWSLGAEMVLFTTMAYDRYVAICFPLHYSTVMNHHMCVALLSMVMAIAVTNSWVHTALIMRLTFCGPNTIDHFFCEIPPLLALSCSPVRINEVMVYVADITLAIGDFILTCISYGFIIVAILRIRTVEGKRKAFSTCSSHLTVVTLYYSPVIYTYIRPASSYTFERDKVVAALYTLVTPTLNPMVYSFQNREMQAGIRKVFAFLKH

SEQ ID NO: 230 - DNA, 924 bp, Homo sapiens
atgaatcacagcgttgtaactgagttcattattctgggcctcaccaaaaagcctgaactccagggaattatcttcctcttttttctcattgtctatcttgtggcttttctcggcaacatgctcatcatcattgccaaaatctataacaacaccttgcatacgcccatgtatgttttccttctgacactggctgttgtggacatcatctgcacaacaagcatcataccgaagatgctggggaccatgctaacatcagaaaataccatttcatatgcaggctgcatgtcccagctcttcttgttcacatggtctctgggagctgagatggttctcttcaccaccatggcctatgaccgctatgtggccatttgtttccctcttcattacagtactgttatgaaccaccatatgtgtgtagccttgctcagcatggtcatggctattgcagtcaccaattcctgggtgcacacagctcttatcatgaggttgactttctgtgggccaaacaccattgaccacttcttctgtgagatacccccattgctggctttgtcctgtagccctgtaagaatcaatgaggtgatggtgtatgttgctgatattaccctggccataggggactttattcttacctgcatctcctatggttttatcattgttgctattctccgtatccgcacagtagaaggcaagaggaaggccttctcaacatgctcatctcatctcacagtggtgaccctttactattctcctgtaatctacacctatatccgccctgcttccagctatacatttgaaagagacaaggtggtagctgcactctatactcttgtgactcccacattaaacccgatggtgtacagcttccagaatagggagatgcaggcaggaattaggaaggtgtttgcatttctgaaacactag

SEQ ID NO: 231 - protein, 315 aa, Homo sapiens
MTNQTQMMEFLLVRFTENWVLLRLHALLFSLIYLTAVLMNLVIILLMILDHRLHMAMYFFLRHLSFLDLCLISATVPKSILNSVASTDSISFLGCVLQLFLVVLLAGSEIGILTAMSYDRYAAICCPLHCEAVMSRGLCVQLMALSWLNRGALGLLYTAGTFSLNFYGSDELHQFFCDVPALLKLTCSKEHAIISVSVAIGVCYAFSCLVCIVVSYVYIFSAVLRISQRQRQSKAFSNCVPHLIVVTVFLVTGAVAYLKPGSDAPSILDLLVSVFYSVAPPTLNPVIYCLKNKDIKSALSKVLWNVRSSGVMKDD

SEQ ID NO: 232 - DNA, 948 bp, Homo sapiens
atgaccaatcagacacagatgatggaattcttgcttgtgagatttactgagaattgggtgctcctgaggctgcatgctttgctcttctcactgatctacctcacggctgtgctgatgaatttagtcatcattctcctcatgattctggaccatcgtctccacatggcaatgtactttttcctccgacatttgtccttcttagacctgtgtctcatttctgccacagtccccaaatccatcctcaactctgtcgcctccactgactccatctccttcctggggtgtgtgttgcagctcttcttggtggtactgctggctggatcagagattggcatccttactgccatgtcctatgaccgctatgctgccatctgctgccccctacactgtgaggctgtcatgagcagagggctctgtgtccagttgatggctctgtcctggctcaacagaggggccttgggactcttgtacacagctggaacattctctctgaatttttatggctctgatgagctacatcagttcttctgcgatgtccctgccctactaaagctcacttgttctaaagaacatgccatcattagtgtcagtgtggccattggggtctgttatgcattttcatgtttagtttgcattgtagtttcctatgtgtacattttctctgctgtgttaaggatatcacagagacagagacaatccaaagccttttccaactgtgtgcctcacctcattgttgtcactgtgtttcttgtaacaggtgctgttgcttatttaaagccagggtctgatgcaccttctattctagacttgctggtgtctgtgttctattctgtcgcacctccaaccttgaaccctgttatctactgtctgaagaacaaggacattaaatccgctctgagtaaagtcctgtggaatgttagaagcagtggggtaatgaaagatgactaa

SEQ ID NO: 233 - protein, 325 aa, Homo sapiens
MFLYLCFIFQRTCSEEMEEENATLLTEFVLTGFLHQPDCKIPLFLAFLVIYLITIMGNLGLIVLIWKDPHLHIPMYLFLGSLAFVDASLSSTVTPKMLINFLAKSKMISLSECMVQFFSLVTTVTTECFLLATMAYDRYVAICKALLYPVIMTNELCIQLLVLSFIGGLLHALIHEAFSFRLTFCNSNIIQHFYCDIIPLLKISCTDSSINFLMVFIFAGSVQVFTIGTILISYTIILFTILEKKSIKGIRKAVSTCGAHLLSVSLYYGPLTFKYLGSASPQADDQDMMESLFYTVIVPLLNPMIYSLRNKQVIASFTKMFKSNV

SEQ ID NO: 234 - DNA, 978 bp, Homo sapiens
atgttcctttacctttgcttcatttttcagaggacatgcagtgaggagatggaagaggaaaatgcaacattgctgacagagtttgttctcacaggatttttacatcaacctgactgtaaaataccgctcttcctggcattcttggtaatatatctcatcaccatcatggggaatcttggtctaattgttctcatctggaaagaccctcaccttcatatcccaatgtacttattccttgggagtttagcctttgtggatgcttcgttatcatccacagtgactccgaagatgctgatcaacttcttagctaagagtaagatgatatctctctctgaatgcatggtacaatttttttcccttgtaaccactgtaaccacagaatgttttctcttggcaacaatggcatatgatcgctatgtagccatttgcaaagctttactttatccagtcattatgaccaatgaactatgcattcagctattagtcttgtcatttataggtggccttcttcatgctttaatccatgaagctttttcattcagattaaccttctgtaattccaacataatacaacacttttactgtgacattatcccattgttaaagatttcctgtactgattcctctattaactttctaatggtttttattttcgcaggttctgttcaagtttttaccattggaactattcttatatcttatacaattatcctctttacaatcttagaaaagaagtctatcaaagggatacgaaaagctgtctccacctgtggggctcatctcttatctgtatctttatactatggccccctcaccttcaaatatctgggctctgcatctccgcaagcagatgaccaagatatgatggagtctctattttacactgtcatagttcctttattaaatcccatgatctacagcctgagaaacaagcaagtaatagcttcattcacaaaaatgttcaaaagcaatgtttag

SEQ ID NO: 235 - protein, 314 aa, Homo sapiens
MSNEDMEQDNTTLLTEFVLTGLTYQPEWKMPLFLVFLVIYLITIVWNLGLIALIWNDPQLHIPMYFFLGSLAFVDAWISSTVTPKMLVNFLAKNRMISLSECMIQFFSFAFGGTTECFLLATMAYDRYVAICKPLLYPVIMNNSLCIRLLAFSFLGGFLHALIHEVLIFRLTFCNSNIIHHFYCDIIPLFMISCTDPSINFLMVFILSGSIQVFTIVTVLNSYTFALFTILKKKSVRGVRKAFSTCGAHLLSVSLYYGPLIFMYLRPASPQADDQDMIDSVFYTIIIPLLNPIIYSLRNKQVIDSFTKMVKRNV

SEQ ID NO: 236 - DNA, 945 bp, Homo sapiens
atgtcgaatgaggacatggaacaggataatacaacattgctgacagagtttgttctcacaggacttacatatcagccagagtggaaaatgcccctgttcttggtgttcttggtgatctatctcatcactattgtgtggaaccttggtctgattgctcttatctggaatgacccacaacttcacatccccatgtacttttttcttgggagtttagcctttgttgatgcttggatatcttccacagtaactcccaaaatgttggttaatttcttggccaaaaacaggatgatatctctgtctgaatgcatgattcaatttttttcctttgcatttggtggaactacagaatgttttctcttggcaacaatggcatatgatcgctatgtagccatatgcaaacctttactatatccagtgattatgaacaattcactatgcatacggctgttagccttctcatttttaggtggcttcctccatgccttaattcatgaagtccttatattcagattaaccttctgcaattctaacataatacatcatttttactgtgatattataccactgtttatgatttcctgtactgacccttctattaattttctaatggtttttattttgtctggctcaattcaggtattcaccattgtgacagttcttaattcttacacatttgctcttttcacaatcctaaaaaagaagtctgttagaggcgtaaggaaagccttttccacctgtggagcccatctcttatctgtctctttatattatggcccacttatcttcatgtatttgcgccctgcatctccacaagcagatgaccaagatatgatagactctgtcttttatacaatcataattcctttgctaaatcccattatctacagtctgagaaataaacaagtaatagattcattcacaaaaatggtaaaaagaaatgtttag

SEQ ID NO: 237 - protein, 308 aa, Homo sapiens
METQNLTVVTEFILLGLTQSQDAQLLVFVLVLIFYLIILPGNFLIIFTIKSDPGLTAPLYFFLGNLALLDASYSFIVVPRMLVDFLSEKKVISYRSCITQLFFLHFLGAGEMFLLVVMAFDRYIAICRPLHYSTIMNPRACYALSLVLWLGGFIHSIVQVALILHLPFCGPNQLDNFFCDVPQVIKLACTNTFVVELLMVSNSGLLSLLCFLGLLASYAVILCRIREHSSEGKSKAISTCTTHIIIIFLMFGPAIFIYTCPFQAFPADKVVSLFHTVIFPLMNPVIYTLRNQEVKASMRKLLSQHMFC

SEQ ID NO: 238 - DNA, 927 bp, Homo sapiens
atggaaacacagaacctcacagtggtgacagaattcattcttcttggtctgacccagtctcaagatgctcaacttctggtctttgtgctagtcttaattttctaccttatcatcctccctggaaatttcctcatcattttcaccataaagtcagaccctgggctcacagcccccctctatttctttctgggcaacttggccttactggatgcatcctactccttcattgtggttcccaggatgttggtggacttcctctctgagaagaaggtaatctcctatagaagctgcatcactcagctctttttcttgcattttcttggagcgggagagatgttcctcctcgttgtgatggcctttgaccgctacatcgccatctgccggcctttacactattcaaccatcatgaaccctagagcctgctatgcattatcgttggttctgtggcttgggggctttatccattccattgtacaagtagcccttatcctgcacttgcctttctgtggcccaaaccagctcgataacttcttctgtgatgttccacaggtcatcaagctggcctgcaccaatacctttgtggtggagcttctgatggtctccaacagtggcctgctcagcctcctgtgcttcctgggccttctggcctcctatgcagtcatcctctgtcgtataagggagcactcctctgaaggaaagagcaaggctatttccacatgcaccacccatattatcattatatttctcatgtttggacctgctattttcatctacacttgccccttccaggctttcccagctgacaaggtagtttctcttttccatactgtcatctttcctttgatgaaccctgttatttatacgcttcgcaaccaggaggtgaaagcttccatgaggaagttgttaagtcaacatatgttttgctga

SEQ ID NO: 239 - protein, 343 aa, Homo sapiens
MALYFSLILHGMSDLFFLSTGHPRASCRMEAMKLLNQSQVSEFILLGLTSSQDVEFLLFALFSVIYVVTVLGNLLIIVTVFNTPNLNTPMYFLLGNLSFVDMTLASFATPKVILNLLKKQKVISFAGCFTQIFLLHLLGGVEMVLLVSMAFDRYVAICKPLHYMTIMNKKVCVLLVVTSWLLGLLHSGFQIPFAVNLPFCGPNVVDSIFCDLPLVTKLACIDIYFVQVVIVANSGIISLSCFIILLISYSLILITIKNHSPTGQSKARSTLTAHITVVILFFGPCIFIYIWPFGNHSVDKFLAVFYTIITPILNPIIYTLRNKEMKISMKKLWRAFVNSREDT

SEQ ID NO: 240 - DNA, 1032 bp, Homo sapiens
atggctctttatttttcactcatactccatggtatgagtgatcttttctttctctctacaggtcatccaagagcgagctgtaggatggaggccatgaaactattaaatcaatctcaagtgtcagaattcattttgctgggactgaccagctcccaggatgtagagtttcttctctttgccctcttctcggttatctatgtggtcacagttttgggtaaccttcttattatagtcacagtgtttaacacccctaacctgaatactcccatgtattttctccttggtaatctctcttttgtagatatgacccttgcttcttttgccacccctaaggtgattctgaacttgttaaaaaagcagaaggtaatttcttttgctgggtgcttcactcagatatttctccttcacttactgggtggggttgaaatggtactgttggtctccatggcttttgacagatatgtggccatttgtaagcccctacactacatgaccatcatgaacaagaaggtatgtgttttgcttgtagtgacctcatggctcttgggtctccttcactcagggtttcagataccatttgctgtgaacttgcccttttgtggtcccaatgtggtagacagcattttttgtgacctccctttggttactaagcttgcctgtatagacatatattttgtacaggtagtcattgttgccaacagtggcataatctccctgagctgtttcattattttgcttatctcctacagtctgatcctcataaccattaagaaccactctcctactgggcaatctaaagcccgttccactttgactgctcacatcacagtggtgattctcttctttggcccatgcatctttatctacatttggcccttcggcaaccactctgtagataagttccttgctgtgttttataccatcatcactcctatcttgaatccaattatctatactctgagaaacaaagaaatgaagatatccatgaaaaaactctggagagcttttgtgaattctagagaagatacttag

SEQ ID NO: 241 - protein, 309 aa, Homo sapiens
MASTSNVTELIFTGLFQDPAVQSVCFVVFLPVYLATVVGNGLIVLTVSISKSLDSPMYFFLSCLSLVEISYSSTIAPKFIIDLLAKIKTISLEGCLTQIFFFHFFGVAEILLIVVMAYDCYVAICKPLHYMNIISRQLCHLLVAGSWLGGFCHSIIQILVIIQLPFCGPNVIDHYFCDLQPLFKLACTDTFMEGVIVLANSGLFSVFSFLILVSSYIVILVNLRNHSAEGRHKALSTCASHITVVILFFGPAIFLYMRPSSTFTEDKLVAVFYTVITPMLNPIIYTLRNAEVKIAIRRLWSKKENPGRE

SEQ ID NO: 242 - DNA, 930 bp, Homo sapiens
atggccagtacaagtaatgtgactgagttgattttcactggccttttccaggatccagctgtgcagagtgtatgctttgtggtgtttctccccgtgtaccttgccacggtggtgggcaatggcctcatcgttctgacggtcagtatcagcaagagtctggattctcccatgtacttcttccttagctgcctgtccttggtggagatcagttattcctccactatcgcccctaaattcatcatagacttacttgccaagattaaaaccatctctctggaaggctgtctgactcagatattcttcttccacttctttggggttgctgagatccttttgattgtggtgatggcctatgattgctacgtggccatttgcaagcctcttcattatatgaacattatcagtcgtcaactgtgtcaccttctggtggctggttcctggctggggggcttttgtcactccataattcagattctcgttatcatccaattgcccttctgtggtcccaatgtgattgaccactatttctgtgacctccagcctttattcaagcttgcctgcactgacaccttcatggagggggttattgtgttggccaacagtggattattctctgtcttctccttcctcatcttggtgtcctcttatattgtcattctggtcaacttgaggaaccattctgcagaggggaggcacaaagccctctccacctgtgcttctcacatcacagtggtcatcttgttttttggacctgctatcttcctctacatgcgaccttcttccactttcactgaagataaacttgtggctgtattctacacggtcatcacccccatgctgaaccccatcatttacacactcaggaatgcagaggtgaaaatcgccataagaagattgtggagcaaaaaggagaatccagggagggagtga

SEQ ID NO: 243 - protein, 305 aa, Homo sapiens
MVATNNVTEIIFVGFSQNWSEQRVISVMFLLMYTAVVLGNGLIVVTILASKVLTSPMYFFLSYLSFVEICYCSVMAPKLIFDSFIKRKVISLKGCLTQMFSLHFFGGTEAFLLMVMAYDRYVAICKPLHYMAIMNQRMCGLLVRIAWGGGLLHSVGQTFLIFQLPFCGPNIMDHYFCDVHPVLELACADTFFISLLIITNGGSISVVSFFVLMASYLIILHFLRSHNLEGQHKALSTCASHVTVVDLFFIPCSLVYIRPCVTLPADKIVAVFYTVVTPLLNPVIYSFRNAEVKNAMRRFIGGKVI

SEQ ID NO: 244 - DNA, 918 bp, Homo sapiens
atggttgctacaaacaatgtgactgaaataattttcgtgggattttcccagaattggagtgagcagagggtcatttctgtgatgtttctcctcatgtacacagctgttgtgctgggcaatggcctcattgtggtgaccatcctggccagcaaagtgctcacctcccccatgtatttctttctcagctacttatcctttgtggagatctgctactgttctgtcatggcccccaagcttatctttgactcctttatcaagaggaaagtcatttctctcaagggctgcctcacacagatgttttccctccatttctttggtggcactgaggcctttctcctgatggtgatggcctatgaccgctatgtggccatctgcaagcccttgcactacatggccatcatgaaccagcgaatgtgtggtctcctcgtgaggatagcatggggcgggggcctgctgcattctgttgggcaaaccttcctgattttccagctcccgttctgtggccccaacatcatggaccactacttctgtgatgtccacccagtgctggagctggcctgcgcagacaccttcttcattagcctgctgatcatcaccaatggcggctccatctccgtagtcagtttcttcgtgctgatggcttcctacctgatcatcctgcacttcctgagaagccacaacttggaggggcagcacaaggccctctccacctgtgcctctcatgtcacagttgtcgacctgttcttcataccttgctccttggtctatattaggccctgtgtcaccctccctgcagacaagatagttgctgtattttatacagtggtcacacctctcttaaaccctgtgatttactccttcaggaatgctgaagtgaaaaatgccatgaggagatttattgggggaaaagtaatttga

SEQ ID NO: 245 - protein, 303 aa, Homo sapiens
MTEFIFLVLSPNQEVQRVCFVIFLFLYTAIVLGNFLIVLTVMTSRSLGSPMYFFLSYLSFMEICYSSATAPKLISDLLAERKVISWWGCMAQLFFLHFFGGTEIFLLTVMAYDHYVAICKPLSYTTIMNWQVCTVLVGIAWVGGFMHSFAQILLIFHLLFCGPNVINHYFCDLVPLLKLACSDTFLIGLLIVANGGTLSVISFGVLLASYMVILLHLRTWSSEGWCKALSTCGSHFAVVILFFGPCVFNSLRPSTTLPIDKMVAVFYTVITAILNPVIYSLRNAEMRKAMKRLWIRTLRLNEK

SEQ ID NO: 246 - DNA, 912 bp, Homo sapiens
atgactgaattcatttttctggtactttctcccaaccaggaggtgcagagggtttgctttgtgatatttctgttcttgtacacagcaattgtgctggggaatttcctcattgtgctcactgtcatgaccagcagaagccttggttcccccatgtacttcttcctcagctacctctccttcatggagatctgctactcctccgctacagcccccaaactcatctcagatctgctggctgaaaggaaagtcatatcttggtggggctgcatggcacagcttttcttcttgcacttctttggtggcactgagattttcctgctcactgtgatggcctatgaccactatgtggccatctgcaagcccctcagctacaccaccatcatgaactggcaggtgtgtactgtccttgtaggaatagcatgggtgggaggcttcatgcattcctttgcacaaatccttctcatcttccacctgctcttctgtggccccaatgtgatcaatcactatttctgtgacctagttccccttctcaaacttgcctgctctgacaccttcctcattggtctgctgattgttgccaatggaggcaccctgtctgtgatcagttttggggtcctcttagcatcctatatggtcatcttgctccatctgagaacctggagctctgaagggtggtgcaaagccctctccacctgtgggtcccatttcgctgtggttatcttgttctttgggccctgcgtcttcaactctctgaggccttctaccactctgcccatagacaagatggtggctgtgttctacacagtgataaccgcgatcctgaaccctgtcatctactctctgagaaatgctgaaatgaggaaggccatgaagaggctgtggattaggacattgagactaaatgagaaatag

SEQ ID NO: 247 - protein, 325 aa, Homo sapiens
MTTIILEVDNHTVTTRFILLGFPTRPAFQLLFFSIFLATYLLTLLENLLIILAIHSDGQLHKPMYFFLSHLSFLEMWYVTVISPKMLVDFLSHDKSISFNGCMTQLYFFVTFVCTEYILLAIMAFDRYVAICNPLRYPVIMTNQLCGTLAGGCWFCGLMTAMIKMVFIAQLHYCGMPQINHYFCDISPLLNVSCEDASQAEMVDFFLALMVIAIPLCVVVASYAAILATILRIPSAQGRQKAFSTCASHLTVVILFYSMTLFTYARPKLMYAYNSNKVVSVLYTVIVPLLNPIIYCLRNHEVKAALRKTIHCRGSGPQGNGAFSS

SEQ ID NO: 248 - DNA, 978 bp, Homo sapiens
atgaccaccataattctggaagtagataatcatacagtgacaacacgtttcattcttctggggtttccaacacgaccagccttccagcttctctttttctccattttcctggcaacctatctgctgacactgctggagaatcttcttatcatcttagctatccacagtgatgggcagctgcataagcccatgtacttcttcttgagccacctctccttcctggagatgtggtatgtcacagtcatcagccccaagatgcttgttgacttcctcagtcatgacaagagtatttccttcaatggctgcatgactcaactttacttttttgtgacctttgtctgcactgagtacatccttcttgctatcatggcctttgaccgctatgtagccatttgtaatccactacgctacccagtcatcatgaccaaccagctctgtggcacactggctggaggatgctggttctgtggactcatgactgccatgattaagatggtttttatagcacaacttcactactgtggcatgcctcagatcaatcactacttttgtgatatctctccactccttaacgtctcctgtgaggatgcctcacaggctgagatggtggacttcttcttggccctcatggtcattgctattcctctttgtgttgtggtggcatcctacgctgctatccttgccaccatcctcaggatcccttctgctcagggccgccaaaaggcattctccacctgtgcctcccacctgaccgtcgtaattctcttctattccatgacacttttcacctatgcccgtcccaaactcatgtatgcctacaattccaacaaagtggtatctgttctctacactgtcattgttccactcctcaaccccatcatttactgtctgaggaaccatgaagtaaaggcagccctcagaaagaccatacattgcagaggaagtgggccccagggaaatggggctttcagtagttaa

SEQ ID NO: 249 - protein, 327 aa, Homo sapiens
MIFPSHDSQAFTSVDMEVGNCTILTEFILLGFSADSQWQPILFGVFLMLYLITLSGNMTLVILIRTDSHLHTPMYFFIGNLSFLDFWYTSVYTPKILASCVSEDKRISLAGCGAQLFFSCVVAYTECYLLAAMAYDRHAAICNPLLYSGTMSTALCTGLVAGSYIGGFLNAIAHTANTFRLHFCGKNIIDHFFCDAPPLVKMSCTNTRVYEKVLLGVVGFTVLSSILAILISYVNILLAILRIHSASGRHKAFSTCASHLISVMLFYGSLLFMYSRPSSTYSLERDKVAALFYTVINPLLNPLIYSLRNKDIKEAFRKATQTIQPQT

SEQ ID NO: 250 - DNA, 984 bp, Homo sapiens
atgattttcccttctcatgatagtcaggctttcacctccgtggacatggaagtgggaaattgcaccatcctgactgaattcatcttgttgggtttctcagcagattcccagtggcagccgattctatttggagtgtttctgatgctctatttgataaccttgtcaggaaacatgaccttggttatcttaatccgaactgattcccacttgcatacacctatgtactttttcattggcaatctgtcttttttggatttctggtatacctctgtgtatacccccaaaatcctggccagttgtgtctcagaagataagcgcatttccttggctggatgtggggctcagctgtttttttcctgtgttgtagcctacactgaatgctatctcctggcagccatggcatatgaccgccatgcagcaatttgtaacccattgctttattcaggtaccatgtccaccgccctctgtactgggcttgttgctggctcctacataggaggatttttgaatgccatagcccatactgccaatacattccgcctgcatttttgtggtaaaaatatcattgaccactttttctgtgatgcaccaccattggtaaaaatgtcctgtacaaacaccagggtctacgaaaaagtcctgcttggtgtggtgggcttcacagtactctccagcattcttgctatcctgatttcctatgtcaacatcctcctggctatcctgagaatccactcagcttcaggaagacacaaggcattctccacctgtgcttcccacctcatctcagtcatgctcttctatggatcattgttgtttatgtattcaaggcctagttccacctactccctagagagggacaaagtagctgctctgttctacaccgtgatcaacccactgctcaaccctctcatctatagcctgagaaacaaagatatcaaagaggccttcaggaaagcaacacagactatacaaccacaaacatga

SEQ ID NO: 251 - protein, 308 aa, Homo sapiens
MTMENYSMAAQFVLDGLTQQAELQLPLFLLFLGIYVVTVVGNLGMILLIAVSPLLHTPMYYFLSSLSFVDFCYSSVITPKMLVNFLGKKNTILYSECMVQLFFFVVFVVAEGYLLTAMAYDRYVAICSPLLYNAIMSSWVCSLLVLAAFFLGFLSALTHTSAMMKLSFCKSHIINHYFCDVLPLLNLSCSNTHLNELLLFIIAGFNTLVPTLAVAVSYAFILYSILHIRSSEGRSKAFGTCSSHLMAVVIFFGSITFMYFKPPSSNSLDQEKVSSVFYTTVIPMLNPLIYSLRNKDVKKALRKVLVGK

SEQ ID NO: 252 - DNA, 927 bp, Homo sapiens
atgaccatggaaaattattctatggcagctcagtttgtcttagatggtttaacacagcaagcagagctccagctgcccctcttcctcctgttcctgggaatctatgtggtcacagtagtgggcaacctgggcatgattctcctgattgcagtcagccctctacttcacacccccatgtactatttcctcagcagcttgtccttcgtcgatttctgctattcctctgtcattactcccaaaatgctggtgaacttcctaggaaagaagaatacaatcctttactctgagtgcatggtccagctctttttctttgtggtctttgtggtggctgagggttacctcctgactgccatggcatatgatcgctatgttgccatctgtagcccactgctttataatgcgatcatgtcctcatgggtctgctcactgctagtgctggctgccttcttcttgggctttctctctgccttgactcatacaagtgccatgatgaaactgtccttttgcaaatcccacattatcaaccattacttctgtgatgttcttcccctcctcaatctctcctgctccaacacacacctcaatgagcttctactttttatcattgcggggtttaacaccttggtgcccaccctagctgttgctgtctcctatgccttcatcctctacagcatccttcacatccgctcctcagagggccggtccaaagcttttggaacatgcagctctcatctcatggctgtggtgatcttctttgggtccattaccttcatgtatttcaagcccccttcaagtaactccctggaccaggagaaggtgtcctctgtgttctacaccacggtgatccccatgctgaaccctttaatatacagtctgaggaataaggatgtgaagaaagcattaaggaaggtcttagtaggaaaatga

SEQ ID NO: 253 - protein, 322 aa, Homo sapiens [sequence omitted]

SEQ ID NO: 254 - DNA, 969 bp, Homo sapiens
atgagccctgagaaccagagcagcgtgtccgagttcctcctcctgggcctccccatccggccagagcagcaggccgtgttcttcgccctgttcctgggcatgtacctgaccacggtgctggggaacctgctcatcatgctgctcatccagctagactctcaccttcacacccccatgtacttcttccttagccacttggccctcactgacatctccttttcatctgtcactgtccctaagatgctgatgaacatgcagactcagcacctagccgtcttttacaagggatgcatttcacagacatattttttcatattttttgctgacttagacagtttccttatcacttcaatggcatatgacaggtatgtggccatctgtcatcctctacattatgccaccatcatgactcagagccagtgtgtcatgctggtggctgggtcctgggtcatcgcttgtgcgtgtgctcttttgcataccctcctcctggcccagctttccttctgtgctgaccacatcatccctcactacttctgtgaccttggtgccctgctcaagttgtcctgctcagacacctccctcaatcagttagcaatctttacagcagcattgacagccattatgcttccattcctgtgcatcctggtttcttatggtcacattggggtcaccatcctccagattccctctaccaagggcatatgcaaagccttgtccacttgtggatcccacctctcagtggtgactatctattatcggacaattattggtctctattttcttcccccatccagcaacaccaatgacaagaacataattgcttcagtgatatacacagcagtcactcccatgttgaacccattcatttacagtctgagaaataaagacattaagggagccctaagaaaactcttgagtaggtcaggcgcagtggctcatgcctgtaatctcagcactttgggaggctga

SEQ ID NO: 255 - protein, 307 aa, Homo sapiens
MLNFTDVTEFILLGLTSRREWQVLFFIVFLVVYIITVVGNIGMMLLIKVSPQLNSPMYFFLSHLSFVDVWFSSNVTPKMLENLFSDKKTISYADCLAQCFFFIALVHVEIFILAAIAFDRYTVIGNPLLYGSKMSRGVCIRLITFPYIYGFLTSLTATLWTYGLYFCGKIEINHFYCADPPLIKMACAGTFVKEYTMLILAGINFTYSLTVIIISYLFILIAILRMRSAEGRQKAFSTCGSHPTAVIIFYGTLIFMYLRRPTEESVEQGKMVAVFYTTVIPMLNPMIYSLRNKDVKKAMMKVISRSC

SEQ ID NO: 256 - DNA, 924 bp, Homo sapiens
atgctcaatttcaccgatgtgacagagttcattcttttggggctaacgagccgtcgggaatggcaagttctcttcttcatcgtttttcttgtggtctacattatcaccgtggtgggcaatatcggcatgatgttgttaatcaaggtcagtcctcagcttaacagccccatgtactttttcctcagtcacttgtcatttgttgatgtgtggttttcttccaatgtcacccctaaaatgttggaaaatctgttatcagataaaaaaacaatttcttatgctggctgtttagcacagtgtttcttcttcattgctcttgtccatgtggaaatttttattcttgctgcgattgcctttgatagatacacagtgattggaaatcctttgctttatggcagcaaaatgtcaagggatgtctgtattcgactgattactttcccttacatttatggttttctgacgagtctgacagcaacattatggacttatggcttgtacttctgtggaaaaattgagatcaaccatttctactgtgcagatccacctctcatcaaaatggcctgtgccgggacctttgtaaaagaatatacaatgctcatacttgccggcatcaacttcacatattccctgactgtaattatcatctcttacttattcatcctcattgccattctgcgaatgcgctcagcagaaggaaggcagaaggccttttccacatgtgggtcccatctgacagctgtcatcatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaa

SEQ ID NO: 257 - protein, 299 aa, Homo sapiens
MGFPGIHSWQHWLSLPLALLYLLALSANILILIIINKEAALHQPMYYFLGILAMADIGLATTIMPKILAILWFNAKTISLLECFAQMYAIHCFVAMESSTFVCMAIDRYVAICRPLRYPSIITESFVFKANGFMALRNSLCLISVPLLAAQRHYCSQNQIEHCLCSNLGVTSLSCDDRRINSINQVLLAWTLMGSDLGLIILSYALILYSVLKLNSPEAASKALSTCTSHLILILFFYTVIIVISITRSTGMRVPLIPVLLNVLHNVIPPALNPMVYALKNKELRQGLYKVLRLGVKGT

SEQ ID NO: 258 - DNA, 900 bp, Homo sapiens
atgggattccctggcattcacagttggcagcactggctctccctgcccctggctctgctctacctcttagctctcagtgccaacatccttatcctgatcatcatcaacaaagaggcagcactgcaccagcctatgtactatttcctgggcatcttggctatggcagacataggcctggctaccaccatcatgcctaagattttggccatcttatggttcaatgctaagaccatcagtctcctggagtgctttgctcagatgtatgccatacattgctttgtggccatggaatcaagtacctttgtctgcatggctattgatagatatgtagccatttgtcgaccgctacgatatccatcaatcatcactgaatcttttgttttcaaagcaaatgggttcatggcactgagaaacagcctgtgtctcatctcagtgcctctgttggctgcccagaggcattactgctcccagaatcaaattgagcactgtctttgttctaaccttggagtcactagcctatcttgtgatgatcgaagaatcaatagcattaaccaggtccttttggcttggacactcatgggaagtgacctgggtttgattattttatcatatgctctaatactttactctgtcctgaagctgaactctccagaagctgcatccaaggccttaagtacctgcacctcccacctcatcttaatccttttcttctacacagtcatcattgtgatttccattactcgtagtacaggaatgagagttccccttattccagttctacttaatgtgctacacaatgtcattccccctgccctgaaccccatggtatatgcactcaagaacaaggaactcaggcaaggcttatacaaggtacttagactgggagtgaagggcacctga

SEQ ID NO: 259 - protein, 321 aa, Homo sapiens
MLTLNKTDLIPASFILNGVPGLEDTQLWISFPFCSMYVVAMVGNCGLLYLIHYEDALHKPMYYFLAMLSFTDLVMCSSTIPKALCIFWFHLKDIGFDECLVQMFFIHTFTGMESGVLMLMALDRYVAICYPLRYSTILTNPVIAKVGTATFLRGVLLIIPFTFLTKRLPYCRGNILPHTYCDHMSVAKLSCGNVKVNAIYGLMVALLIGGFDILCITISYTMILRAVVSLSSADARQKAFNTCTAHICAIVFSYTPAFFSFFSHRFGEHIIPPSCHIIVANIYLLLPPTMNPIVYGVKTKQIRDCVIRILSGSKDTKSYSM

SEQ ID NO: 260 - DNA, 966 bp, Homo sapiens
atgctaacactgaataaaacagacctaataccagcttcatttattctgaatggagtcccaggactggaagacacacaactctggatttccttcccattctgctctatgtatgttgtggctatggtagggaattgtggactcctctacctcattcactatgaggatgccctgcacaaacccatgtactacttcttggccatgctttcctttactgaccttgttatgtgctctagtacaatccctaaagccctctgcatcttctggtttcatctcaaggacattggatttgatgaatgccttgtccagatgttcttcatccacaccttcacagggatggagtctggggtgcttatgcttatggccctggatcgctatgtggccatctgctaccccttacgctattcaactatcctcaccaatcctgtaattgcaaaggttgggactgccaccttcctgagaggggtattactcattattccctttactttcctcaccaagcgcctgccctactgcagaggcaatatacttccccatacctactgtgaccacatgtctgtagccaaattgtcctgtggtaatgtcaaggtcaatgccatctatggtctgatggttgccctcctgattgggggctttgacatactgtgtatcaccatctcctataccatgattctccgggcagtggtcagcctctcctcagcagatgctcggcagaaggcctttaatacctgcactgcccacatttgtgccattgttttctcctatactccagctttcttctccttcttttcccaccgctttggggaacacataatccccccttcttgccacatcattgtagccaatatttatctgctcctaccacccactatgaaccctattgtctatggggtgaaaaccaaacagatacgagactgtgtcataaggatcctttcaggttctaaggataccaaatcctacagcatgtga

SEQ ID NO: 261 - protein, 329 aa, Homo sapiens [sequence omitted]

SEQ ID NO: 262 - DNA, 990 bp, Homo sapiens
atgtccagcactcttggccacaacatggaatctcctaatcacactgatgttgacccttctgtcttcttcctcctgggcatcccaggtctggaacaatttcatttgtggctctcactccctgtgtgtggcttaggcacagccacaattgtgggcaatataactattctggttgttgttgccactgaaccagtcttgcacaagcctgtgtacctttttctgtgcatgctctcaaccatcgacttggctgcctctgtctccacagttcccaagctactggctatcttctggtgtggagccggacatatatctgcctctgcctgcctggcacagatgttcttcattcatgccttctgcatgatggagtccactgtgctactggccatggcctttgatcgctacgtggccatctgccacccactccgctatgccacaatcctcactgacaccatcattgcccacataggggtggcagctgtagtgcgaggctccctgctcatgctcccatgtcccttccttattgggcgtttgaacttctgccaaagccatgtgatcctacacacgtactgtgagcacatggctgtggtgaagctggcctgtggagacaccaggcctaaccgtgtgtatgggctgacagctgcactgttggtcattggggttgacttgttttgcattggtctctcctatgccctaagtgcacaagctgtccttcgcctctcatcccatgaagctcggtccaaggccctagggacctgtggttcccatgtctgtgtcatcctcatctcttatacaccagccctcttctccttttttacacaccgctttggccatcacgttccagtccatattcacattcttttggccaatgtttatctgcttttgccacctgctcttaatcctgtggtatatggagttaagaccaaacagatccgtaaaagagttgtcagggtgtttcaaagtgggcagggaatgggcatcaaggcatctgagtga

SEQ ID NO: 263 - protein, 314 aa, Homo sapiens
MLGLNGTPFQPATLQLTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKVACGDIHVNNIYGLLVIIFTYGMDSTFILLSYALILRAMLVIISQEQRLKALNTCMSHICAVLAFYVPIIAVSMIHRFWKSAPPVVHVMMSNVYLFVPPMLNPIIYSVKTKEIRKGILKFFHKSQA

SEQ ID NO: 264 - DNA, 945 bp, Homo sapiens
atgctgggtctcaatggcacccccttccagccagcaacactccagctgacaggcattcctgggatacaaacaggcctcacctgggttgccctgattttctgcatcctctacatgatctccattgtaggtaacctcagcattctcactctggtgttttgggagcctgctctgcatcagcccatgtactacttcctctctatgctcgctctcaatgatctgggagtgtccttttctacacttcccactgtgatttctactttctgcttcaactacaaccatgttgcgtttaatgcttgcctggtccagatgttcttcatccacactttctccttcatggagtcaggcatactgctggccatgagcttggatcgctttgtggctatttgttatccattacgctatgtcactgtgctcactcacaaccgtatattggctatgggtctgggcatccttaccaagagtttcaccactctcttccctttcccttttgtggtgaaacgactgcccttctgcaaaggcaatgttttgcatcactcctactgtctccatccagatctcatgaaagtagcatgtggagacatccatgttaacaacatttatgggctcttggtgatcatttttacctatggtatggactcaactttcatcctgctttcctacgcattgatcctgagagccatgctggtcatcatatcccaggaacagcggctcaaggcactcaacacctgcatgtcacacatctgtgcagtgctggccttttatgtgcccataattgctgtctccatgattcaccgcttctggaaaagtgctccacctgttgttcatgtcatgatgtccaatgtctacctgtttgtaccacccatgctcaaccctatcatctacagtgtgaaaaccaaggagatccgcaaagggattctcaagttcttccataaatcccaggcctga

SEQ ID NO: 265 - protein, 312 aa, Homo sapiens
MGLFNVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFHHIKI

SEQ ID NO: 266 - DNA, 939 bp, Homo sapiens
atggggttgttcaatgtcactcaccctgcattcttcctcctgactggtatccctggtctggagagctctcactcctggctgtcagggcccctctgcgtgatgtatgctgtggcccttgggggaaatacagtgatcctgcaggctgtgcgagtggagcccagcctccatgagcccatgtactacttcctgtccatgttgtccttcagtgatgtggccatatccatggccacactgcccactgtactccgaaccttctgcctcaatgcccgcaacatcacttttgatgcctgtctaattcagatgtttcttattcacttcttctccatgatggaatcaggtattctgctggccatgagttttgaccgctatgtggccatttgtgaccccttgcgctatgcaactgtgctcaccactgaagtcattgctgcaatgggtttaggtgcagctgctcgaagcttcatcacccttttccctcttccctttcttattaagaggctgcctatctgcagatccaatgttctttctcactcctactgcctgcacccagacatgatgaggcttgcctgtgctgatatcagtatcaacagcatctatggactctttgttcttgtatccacctttggcatggacctgttttttatcttcctctcctatgtgctcattctgcgttctgtcatggccactgcttcccgtgaggaacgcctcaaagctctcaacacatgtgtgtcacatatcctggctgtacttgcattttatgtgccaatgattggggtctccacagtgcaccgctttgggaagcatgtcccatgctacatacatgtcctcatgtcaaatgtgtacctatttgtgcctcctgtgctcaaccctctcatttatagcgccaagacaaaggaaatccgccgagccattttccgcatgtttcaccacatcaaaatatga

SEQ ID NO: 267 - protein, 326 aa, Homo sapiens
MSVQYSLSPQFMLLSNITQFSPIFYLTSFPGLEGIKHWIFIPFFFMYMVAISGNCFILIIIKTNPRLHTPMYYLLSLLALTDLGLCVSTLPTTMGIFWFNSQSIYFGACQIQMFCIHSFSFMESSVLLMMSFDRFVAICHPLRYSVIITGQQVVRAGLIVIFRGPVATIPIVLLLKAFPYCGSVVLSHSFCLHQEVIQLACTDTTFNNLYGLMVVVFTVMLDLVLIALSYGLILHTVAGLASQEEQRRAFQTCTAHLCAVLVFFVPMMGLSLVHRFGKHAPPAIHLLMANVYLFVPPMLNPIIYSIKTKEIHRAIIKLLGLKKASK

SEQ ID NO: 268 - DNA, 981 bp, Homo sapiens
atgtcagtccaatattcgctcagtcctcaattcatgctgctatccaacattactcagtttagccccatattctatctcaccagctttcctggattggaaggcatcaaacactggattttcatcccctttttctttatgtacatggttgccatctcaggcaattgtttcattctgatcattattaagaccaaccctcgtctgcacacacccatgtactatctactatccttgctggccctcactgacctggggctgtgtgtgtccacgttgcccaccactatggggatcttctggtttaactcccagagtatctactttggagcgtgtcaaatccagatgttctgcatccactctttttccttcatggagtcctcagtgctcctcatgatgtcctttgaccgctttgtggccatctgccaccctctgaggtattcggtcattatcactggccagcaagtggtcagagcaggcctaattgtcatcttccggggacctgtggccactatccctattgtcctcctcctgaaggcttttccctactgtggatctgtggtcctctcccactcattttgcctgcaccaggaagtgatacagctggcctgcacagataccaccttcaataatctgtatggactgatggtggtagttttcactgtgatgctggacctggtgctcatcgcactgtcctatggactcatcctgcacacagtagcaggcctggcctcccaagaggagcagcgccgtgcctttcagacatgcaccgctcatctctgtgctgtgctagtattctttgtgcccatgatggggctgtccctggtgcaccgttttgggaagcatgccccacctgctattcatcttcttatggccaatgtctacctttttgtgcctcccatgcttaacccaatcatatacagcattaagaccaaggagatccaccgtgccattatcaaactcctaggtcttaaaaaggccagtaaatga

SEQ ID NO: 269 - protein, 317 aa, Homo sapiens
MSQVTNTTQEGIYFILTDIPGFEASHIWISIPVCCLYTISIMGNTTILTVIRTEPSVHQRMYLFLSMLALTDLGLTLTTLPTVMQLLWFNVRRISSEACFAQFFFLHGFSFMESSVLLAMSVDCYVAICCPLHYASILTNEVIGRTGLAIICCCVLAVLPSLFLLKRLPFCHSHLLSRSYCLHQDMIRLVCADIRLNSWYGFALALLIIIVDPLLIVISYTLILKNILGTATWAERLRALNNCLSHILAVLVLYIPMVGVSMTHRFAKHASPLVHVIMANIYLLAPPVMNPIIYSVKNKQIQWGMLNFLSLKNMHSR

SEQ ID NO: 270 - DNA, 954 bp, Homo sapiens
atgtcccaggtgactaacaccacacaagaaggcatctacttcatcctcacggacatccctggatttgaggcctcccacatctggatctccatccccgtctgctgtctctacaccatctccatcatgggcaataccaccatcctcactgtcattcgcacagagccatctgtccaccagcgcatgtatctgtttctctccatgctggccctgacggacctgggtctcaccctcaccaccctacccacagtcatgcagcttctctggttcaacgttcgtagaatcagctctgaggcctgttttgctcagtttttcttccttcatggattctcctttatggagtcttctgtcctcctggctatgtccgttgactgctatgtggccatctgctgtcccctccattatgcctccatcctcaccaatgaagtcattggtagaactgggttagccatcatttgctgctgtgttctggcggttcttccctcccttttcttactcaagcgactgcctttctgccactcccaccttctctctcgctcctattgcctccaccaggatatgatccgcctggtctgtgctgacatcaggctcaacagctggtatggatttgctcttgccttgctcattattatcgtggatcctctgctcattgtgatctcctatacacttattctgaaaaatatcttgggcacagccacctgggctgagcgactccgtgccctcaataactgcctgtcccacattctagctgtcctggtcctctacattcccatggttggtgtatctatgactcatcgctttgccaagcatgcctctccactggtccatgttatcatggccaatatctacctgctggcacccccggtgatgaaccccatcatttacagtgtaaagaacaagcagatccaatggggaatgttaaatttcctttccctcaaaaatatgcattcaagatga

SEQ ID NO: 271 - protein, 320 aa, Homo sapiens
MPSASAMIIFNLSSYNPGPFILVGIPGLEQFHVWIGIPFCIIYIVAVVGNCILLYLIVVEHSLHEPMFFFLSMLAMTDLILSTAGVPKALSIFWLGAREITFPGCLTQMFFLHYNFVLDSAILMAMAFDHYVAICSPLRYTTILTPKTIIKSAMGISFRSFCIILPDVFLLTCLPFCRTRIIPHTYCEHIGVAQLACADISINFWYGFCVPIMTVISDVILIAVSYAHILCAVFGLPSQDACQKALGTCGSHVCVILMFYTPAFFSILAHRFGHNVSRTFHIMFANLYIVIPPALNPMVYGVKTKQIRDKVILLFSKGTG

SEQ ID NO: 272 - DNA, 963 bp, Homo sapiens
atgccatctgcctctgccatgatcattttcaacctgagcagttacaatccaggacccttcattctggtagggatcccaggcctggagcaattccatgtgtggattggaattcccttctgtatcatctacattgtagctgttgtgggaaactgcatccttctctacctcattgtggtggagcatagtcttcatgaacccatgttcttctttctctccatgctggccatgactgacctcatcttgtccacagctggtgtgcctaaagcactcagtatcttttggctaggggctcgcgaaatcacattcccaggatgccttacacaaatgttcttccttcactataactttgtcctggattcagccattctgatggccatggcatttgatcactatgtagctatctgttctcccttgagatataccaccatcttgactcccaagaccatcatcaagagtgctatgggcatctcctttcgaagcttctgcatcatcctgccagatgtattcttgctgacatgcctgcctttctgcaggacacgcatcataccccacacatactgtgagcatataggtgttgcccagctcgcctgtgctgatatctccatcaacttctggtatggcttttgtgttcccatcatgacggtcatctcagatgtgattctcattgctgtttcctacgcacacatcctctgtgctgtctttggccttccctcccaagatgcctgccagaaagccctcggcacttgtggttctcatgtctgtgtcatcctcatgttttatacacctgcctttttctccatcctcgcccatcgctttggacacaatgtctctcgcaccttccacatcatgtttgccaatctctacattgttatcccacctgcactcaaccccatggtttacggagtgaagaccaagcagatcagagataaggttatacttttgttttctaagggtacaggatga

SEQ ID NO: 273 - protein, 318 aa, Homo sapiens
MPTVNHSGTSHTVFHLLGIPGLQDQHMWISIPFFISYVTALLGNSLLIFIILTKRSLHEPMYLFLCMLAGADIVLSTCTIPQALAIFWFRAGDISLDRCITQLFFIHSTFISESGILLVMAFDHYIAICYPLRYTTILTNALIKKICVTVSLRSYGTIFPIIFLLKRLTFCQNNIIPHTFCEHIGLAKYACNDIRINIWYGFSILMSTVVLDVVLIFISYMLILHAVFHMPSPDACHKALNTFGSHVCIIILFYGSGIFTILTQRFGRHIPPCIHIPLANVCILAPPMLNPIIYGIKTKQIQEQVVQFLFIKQKITLV

SEQ ID NO: 274 - DNA, 957 bp, Homo sapiens
atgcctactgtaaaccacagtggcactagccacacagtcttccacttgctgggcatccctggcctacaggaccagcacatgtggatttctatcccattcttcatttcctatgtcaccgcccttcttgggaacagcctgctcatcttcattatcctcacaaagcgcagcctccatgaacccatgtacctcttcctctgcatgctggctggagcagacattgtcctctccacgtgcaccattcctcaggccttagctatcttctggttccgtgctggggacatctccctggatcgttgcatcactcagctcttcttcatccattccaccttcatctctgagtcagggatcttgctggtgatggcctttgaccactatattgccatatgctacccactgaggtacaccaccattcttacaaatgctctgatcaagaaaatttgtgtgactgtctctctgagaagttatggtacaattttccctatcatatttcttttaaaaagattgactttctgccagaataatattattccacacaccttttgtgaacacattggcctagccaaatatgcatgtaatgacattcgaataaacatttggtatgggttttccattctaatgtcgacggtggtcttagatgttgtactaatttttatttcctatatgctgattctccatgctgtcttccacatgccttctccagatgcttgccacaaagctctcaacacatttggctcccatgtctgcatcatcatcctcttttatgggtctggcatcttcacaatccttacccagaggtttggacgccacattccaccttgtatccacatcccgttggctaatgtctgcattctggctccacctatgctgaatcccattatttatgggatcaaaaccaagcaaatccaggaacaggtggttcagtttttgtttataaaacagaaaataactttggtttaa

SEQ ID NO: 275 - protein, 311 aa, Homo sapiens
MSNASLLTAFILMGLPHAPALDAPLFGVFLVVYVLTVLGNLLILLVIRVDSHLHTTMYYFLTNLSFIDMWFSTVTVPKLLMTLVFPSGRAISFHSCMAQLYFFHFLGGTECFLYRVMSCDRYLAISYPLRYTSMMTGRSCTLLATSTWLSGSLHSAVQAILTFHLPYCGPNWIQHYLCDAPPILKLACADTSAIETVIFVTVGIVASGCFVLIVLSYVSIVCSILRIRTSEGKHRAFQTCASHCIVVLCFFGPGLFIYLRPGSRKAVDGVVAVFYTVLTPLLNPVVYTLRNKEVKKALLKLKDKVAHSQSK

SEQ ID NO: 276 - DNA, 936 bp, Homo sapiens
atgtccaacgccagcctactgacagcgttcatcctcatgggccttccccatgccccagcgctggacgcccccctctttggagtcttcctggtggtttacgtgctcactgtgctggggaacctcctcatcctgctggtgatcagggtggattctcacctccacaccaccatgtactacttcctcaccaacctgtcgttcattgacatgtggttctccactgtcacggtgcccaaattgctgatgactttggtgttcccaagtggcagggctatctccttccacagctgcatggctcagctctatttctttcacttcctagggggcaccgagtgtttcctctacagggtcatgtcctgtgatcgctacctggccatcagttacccgctcaggtacaccagcatgatgactgggcgctcgtgtactcttctggccaccagcacttggctcagtggctctctgcactctgctgtccaggccatattgactttccatttgccctactgtggacccaactggatccagcactatttgtgtgatgcaccgcccatcctgaaactggcctgtgcagacacctcagccatagagactgtcatttttgtgactgttggaatagtggcctcgggctgctttgtcctgatagtgctgtcctatgtgtccatcgtctgttccatcctgcggatccgcacctcagaggggaagcacagagcctttcagacctgtgcctcccactgtatcgtggtcctttgcttctttggccctggtcttttcatttacctgaggccaggctccaggaaagctgtggatggagttgtggccgttttctacactgtgctgacgccccttctcaaccctgttgtgtacaccctgaggaacaaggaggtgaagaaagctctgttgaagctgaaagacaaagtagcacattctcagagcaaatag

SEQ ID NO: 277 - protein, 308 aa, Homo sapiens
MELGNVTRVKEFIFLGLTQSQDQSLVLFLFLCLVYMTTLLGNLLIMVTVTCESRLHTPMYFLLRNLAILDICFSSTTAPKVLLDLLSKKKTISYTSCMTQIFLFHLLGGADIFSLSVMAFDCYMAISKPLHYVTIMSRGQCTALISASWMGGFVHSIVQISLLLPLPFCGPNVLDTFYCDVPQVLKLTCTDTFALEFLMISNNGLVTTLWFIFLLVSYTVILMTLRSQAGGGRRKAISTCTSPHHCGDPAFCALHLCLCPALHCPPHRKGHLCHLHCHLPSAEPFDLHSEEPGNEVSHEKTEEKTRAF

SEQ ID NO: 278 - DNA, 927 bp, Homo sapiens
atggagttgggaaatgtcaccagagtaaaagaatttatatttctgggacttactcaatcccaagaccagagtttggtcttgtttctttttttatgtcttgtgtacatgacgactctgctgggaaacctcctcatcatggtcaccgtgacctgtgagtctcgccttcacacccccatgtacttcctgctccgcaatctagccatccttgacatctgcttctcctccacaactgctcctaaagtcttgctggaccttctgtcaaagaaaaagaccatatcctatacaagctgcatgacacagatatttctcttccacctccttggtggggcagacattttttctctctctgtgatggcgtttgactgctacatggccatctccaagcccctgcactatgtgaccatcatgagtagagggcaatgcactgccctcatctctgcctcttggatggggggctttgtccactccatcgtgcagatctccctgttgctgcctctccctttctgtggacccaatgttcttgacactttctactgcgatgtcccccaggtcctcaaactcacttgcactgacacttttgctcttgagttcttgatgatttccaacaatggcctggtcactaccctgtggtttatcttcctgcttgtgtcctacacagtcatcctaatgacgctgaggtctcaggcaggagggggcaggaggaaagccatctccacttgcacctccccacatcactgtggtgaccctgcattttgtgccctgcatctatgtctatgcccggcccttcactgccctccccacagaaaaggccatctctgtcaccttcactgtcatctcccctctgctgaaccctttgatctacactctgaggaaccaggaaatgaagtcagccatgagaagactgaagagaagactcgtgccttctga

SEQ ID NO: 279 - protein, 315 aa, Homo sapiens
MFSPNHTIVTEFILLGLTDDPVLEKILFGVFLAIYLITLAGNLCMILLIRTNSHLQTPMYFFLGHLSFVDICYSSNVTPNMLHNFLSEQKTISYAGCFTQCLLFIALVITEFYILASMALDRYVAICSPLHYSSRMSKNICVCLVTIPYMYGFLSGFSQSLLTFHLSFCGSLEINHFYCADPPLIMLACSDTRVKKMAMFVVAGFNLSSSLFIILLSYLFIFAAIFRIRSAEGRHKAFSTCASHLTIVTLFYGTLFCMYVRPPSEKSVEESKITAVFYTFLSPMLNPLIYSLRNTDVILAMQQMIRGKSFHKIAV

SEQ ID NO: 280 - DNA, 948 bp, Homo sapiens
atgttctccccaaaccacaccatagtgacagaattcattctcttgggactgacagacgacccagtgctagagaagatcctgtttggggtattccttgcgatctacctaatcacactggcaggcaacctgtgcatgatcctgctgatcaggaccaattcccacctgcaaacacccatgtatttcttccttggccacctctcctttgtagacatttgctattcttccaatgttactccaaatatgctgcacaatttcctctcagaacagaagaccatctcctacgctggatgcttcacacagtgtcttctcttcatcgccctggtgatcactgagttttacatccttgcttcaatggcattggatcgctatgtagccatttgcagccctttgcattacagttccaggatgtccaagaacatctgtgtctgtctggtcactatcccttacatgtatgggtttcttagtgggttctctcagtcactgctaacctttcacttatccttctgtggctcccttgaaatcaatcatttctactgcgctgatcctcctcttatcatgctggcctgctctgacacccgtgtcaaaaagatggcaatgtttgtagttgcaggctttaatctctcaagctctctcttcatcattcttctgtcctatcttttcatttttgcagcgatcttcaggatccgttctgctgaaggcaggcacaaagccttttctacgtgtgcttcccacctgacaatagtcactttgttttatggaaccctcttctgcatgtacgtaaggcctccatcagagaagtctgtagaggagtccaaaataactgcagtcttttatacttttttgagcccaatgctgaacccattgatctatagcctacggaacacagatgtaatccttgccatgcaacaaatgattaggggaaaatcctttcataaaattgcagtttag

SEQ ID NO: 281 - protein, 314 aa, Homo sapiens
MDQINHTNVKEFFFLELTRSRELEFFLFVVFFAVYVATVLGNALIVVTITCESRLHTPMYFLLRNKSVLDIVFSSITVPKFLVDLLSDRKTISYNDCMAQIFFFHFAGGADIFFLSVMAYDRYLAIAKPLHYVTMMRKEVWVALVVASWVSGGLHSIIQVILMLPFPFCGPNTLDAFYCYVLQVVKLACTDTFALELFMISNNGLVTLLWFLLLLGSYTVILVMLRSHSGEGRNKALSTCTSHMLVVTLHFVPCVYIYCRPFMTLPMDTTISINNTVITPMLNPIIYSLRNQEMKSAMQRLQRRLGPSESRKWG

SEQ ID NO: 282 - DNA, 945 bp, Homo sapiens
atggaccagatcaaccacactaatgtgaaggagtttttcttcctggaacttacacgttcccgagagctggagtttttcttgtttgtggtcttctttgctgtgtatgtagcaacagtcctgggaaatgcactcattgtggtcactattacctgtgagtcccgcctacacactcctatgtactttctcctgcggaacaaatcagtcctggacatcgttttttcatctatcaccgtccccaagttcctggtggatcttttatcagacaggaaaaccatctcctacaatgactgcatggcacagatctttttcttccactttgctggtggggcagatatttttttcctctctgtgatggcctatgacagataccttgcaatcgccaagcccctgcactatgtgaccatgatgaggaaagaggtgtgggtggccttggtggtggcttcttgggtgagtggtggtttgcattcaatcatccaggtaattctgatgcttccattccccttctgtggccccaacacactggatgccttctactgttatgtgctccaggtggtaaaactggcctgcactgacacctttgctttggagcttttcatgatctctaacaacggactggtgaccctgctctggttcctcctgctcctgggctcctacactgtcattctggtgatgctgagatcccactctggggaggggcggaacaaggccctctccacgtgcacgtcccacatgctggtggtgactcttcacttcgtgccttgtgtttacatctactgccggcccttcatgacgctgcccatggacacaaccatatccattaataacacggtcattacccccatgctgaaccccatcatctattccctgagaaatcaagagatgaagtcagccatgcagaggctgcagaggagacttgggccttccgagagcagaaaatgggggtga

SEQ ID NO: 283 - protein, 311 aa, Homo sapiens
  MOD_RES (253): Variable amino acid
MSKTSLVTAFILTGLPHAPGLDAPLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATSTWLSGSLHSAVQTILTFHLPYCGPNQIQHYLCDAPPILKLACADTSANEMVIFVDIGLVASGCFLLIVLSYVSIVCSILRIHTSEGRHRAFQTCASHCIVVLCFFVXCVFIYLRPGSRDVVDGVVAIFYTVLTPLLNPVVYTLRNKEVKKAVLKLRDKVAHSQGE

SEQ ID NO: 284 - DNA, 936 bp, Homo sapiens
  modified_base (756)..(757): A, T, C or G
atgtccaagaccagcctcgtgacagcgttcatcctcacgggccttccccatgccccagggctggacgccccactctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcagatgtgccctcctggccaccagcacttggctcagtggctctctgcactctgctgtccagaccatattgactttccatttgccctactgtggacccaaccagatccagcactatttgtgtgatgcaccgcccatcctgaaactggcctgtgcagacacctcagccaacgagatggtcatctttgtggacattgggctagtggcctcgggctgctttctcctgatagtgctgtcttatgtgtccatcgtctgttccatcctgcggatccacacctcagaggggaggcacagagcctttcagacctgtgcctcccactgcatcgtggtcctttgcttttttgtnncctgtgttttcatttacctgagaccaggctccagggacgtcgtggatggagttgtggccattttctacactgtgctgacaccccttctcaaccctgttgtgtacaccctgagaaacaaggaggtgaagaaagctgtgttgaaactgagagacaaagtagcacattctcagggagaataa

SEQ ID NO: 285 - protein, 331 aa, Homo sapiens
  MOD_RES (253): Variable amino acid
MCWAMPSPFTGSSTRNMESRNQSTVTEFIFTGFPQLQDGSLLYFFPLLFIYTFIIIDNLLIFSAVRLDTHLGNPMYNFISIFSFLEIWYTTATIPKMLSNLISEKKAISMTGCILQMYFFHSLENSEGILLTTMAIDRYVAICNPLRYQMIMTPRLCAHLSAGSCLFGFLILLPEIVMISTLPFCGPNQIHQIFCDLVPVLSLACTDTSMILIEDVIHAVTIIITFLIIALSYVRIVTVILRIPSSEGRQKAXSTCAGHLMVFLIFFGSVSLMYLRFSNTYPPVLDTAIALMFTVLAPFFNPIIYSLRNKDMNNAIKKLFCLQKVLNKPGG

SEQ ID NO: 286 - DNA, 996 bp, Homo sapiens
  modified_base (757): A, T, C or G
atgtgctgggctatgccctctccatttacaggtagctctactagaaatatggagagcagaaaccaatcaacagtgactgaatttatcttcactggattccctcagcttcaggatggtagtctcctgtacttctttcctttacttttcatctatacttttattatcattgataacttattaatcttctctgctgtaaggctggacacccatctgggcaaccccatgtataattttatcagtatattttcctttctggagatctggtacaccacagccaccattcccaagatgctctccaacctcatcagtgaaaagaaggccatctcaatgactggctgcatcttgcagatgtatttcttccactcacttgaaaactcagaggggatcttgctgaccaccatggccattgacagatacgttgccatctgcaaccctcttcgctatcaaatgatcatgaccccccggctctgtgctcacctctctgcaggttcctgcctcttcggtttccttatcctgcttcccgagattgtgatgatttccacactgcctttctgtgggcccaaccaaatccatcagatcttctgtgacttggtccctgtgctaagcctggcctgtacagacacgtccatgattctgattgaggatgtgattcatgctgtgaccatcatcattaccttcctaatcattgccctgtcctatgtaagaattgtcactgtgatattgaggattccctcttctgaagggaggcaaaaggctntttctacctgtgcaggccacctcatggtcttcctgatattctttggcagtgtatcactcatgtacttgcgtttcagcaacacttatccaccagttttggacacagccattgcactgatgtttactgtacttgctccattcttcaatcccatcatttatagcctgagaaacaaggacatgaacaatgcaattaaaaaactgttctgtcttcaaaaagtgttgaacaagcctggaggttaa

SEQ ID NO: 287 - protein, 308 aa, Homo sapiens [sequence omitted]

SEQ ID NO: 288 - DNA, 927 bp, Homo sapiens
atggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccaggctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtgtgtgtctgcttggttgctacctcatgggggacatcacttgtgctcactgccatgctcatcctatccctgaggcttcacttctgtggggctaatgtcatcaaccattttgcctgtgagattctctccctcattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctcccctgaccaggacaagtttatctcagtgttttatggagctttgacacccatgttgaaccccctgatatatagcctgagaaaaaaagatgttaaacgggcaataaggaaagttatgttgaaaaggacatga

SEQ ID NO: 289 - protein, 312 aa, Homo sapiens
MKAGNFSDTPEFFLLGLSGDPELQPILFMLFLSMYLATMLGNLLIILAVNSDSHLHTPMYFLLSILSLVDICFTSTTMPKMLVNIQAQAQSINYTGCLTQICFVLVFVGLENGILVMMAYDRFVAICHPLRYNVIMNPKLCGLLLLLSFIVSVLDALLHTLMVLQLTFCIDLEIPHFFCELAHILKLACSDVLINNILVYLVTSLLGVVPLSGIIFSYTRIVSSVMKIPSAGGKYKAFSICGSHLIVVSLFYGTGFGVYLSSGATHSSRKGAIASVMYTVVTPMLNPLIYSLRNKDMLKALRKLISRIPSFH

SEQ ID NO: 290 - DNA, 939 bp, Homo sapiens
atgaaagcaggaaacttctcagacactccagaattctttctcttgggattgtcaggggatccggagctgcagcccatcctcttcatgctgttcctgtccatgtacctggccacaatgctggggaacctgctcatcatcctggccgtcaactctgactcccacctccacacccccatgtacttcctcctctctatcctgtccttggtcgacatctgtttcacctccaccacgatgcccaagatgctggtgaacatccaggcacaggctcaatccatcaattacacaggctgcctcacccaaatctgctttgtcctggtttttgttggattggaaaatggaattctggtcatgatggcctatgatcgatttgtggccatctgtcacccactgaggtacaatgtcatcatgaaccccaaactctgtgggctgctgcttctgctgtccttcatcgttagtgtcctggatgctctgctgcacacgttgatggtgctacagctgaccttctgcatagacctggaaattccccactttttctgtgaactagctcatattctcaagctcgcctgttctgatgtcctcatcaataacatcctggtgtatttggtgaccagcctgttaggtgttgttcctctctctgggatcattttctcttacacacgaattgtctcctctgtcatgaaaattccatcagctggtggaaagtataaagctttttccatctgcgggtcacatttaatcgttgtttccttgttttatggaacagggtttggggtgtaccttagttctggggctacccactcctccaggaagggtgcaatagcatcagtgatgtataccgtggtcacccccatgctgaacccactcatttacagcctgagaaacaaggacatgttgaaggctttgaggaaactaatatctaggataccatctttccattga

SEQ ID NO: 291 - protein, 311 aa, Homo sapiens
MGPRNQTAVSEFLLMKVTEDPELKLIPFSLFLSMYLVTILGNLLILLAVISDSHLHTPMYFLLFNLSFTDICLTTTTVPKILVNIQAQNQSITYTGCLTQICLVLVFAGLESCFLAVMAYDRYVAICHPLRYTVLMNVHFWGLLILLSMFMSTMDALVQSLMVLQLSFCKNVEIPLFFCEVVQVIKLACSDTLINNILIYFASSVFGAIPLSGIIFSYSQIVTSVLRMPSARGKYKAFSTCGCHLSVFSLFYGTAFGVYISSAVAESSRITAVASVMYTVVPQMMNPFIYSLRNKEMKKALRKLIGRLFPF

SEQ ID NO: 292 - DNA, 936 bp, Homo sapiens
atgggacccagaaaccaaacagctgtttcagaatttcttctcatgaaagtgacagaggacccagaactgaagttaatccctttcagcctgttcctgtccatgtacctggtcaccatcctggggaacctgctcattctcctggctgtcatctctgactcccacctccacacccccatgtacttccttctctttaatctctcctttactgacatctgtttaaccacaaccacagtcccaaagatcctagtgaacatccaagctcagaatcagagtatcacttacacaggctgcctcacccagatctgtcttgtcttggtttttgctggcttggaaagttgctttcttgcagtcatggcctacgaccgctatgtggccatttgccacccactgaggtacacagtcctcatgaatgtccatttctggggcttgctgattcttctctccatgttcatgagcactatggatgccctggttcagagtctgatggtattgcagctgtccttctgcaaaaacgttgaaatccctttgttcttctgtgaagtcgttcaggtcatcaagctcgcctgttctgacaccctcatcaacaacatcctcatatattttgcaagtagtgtatttggtgcaattcctctctctggaataattttctcttattctcaaatagtcacctctgttctgagaatgccatcagcaagaggaaagtataaagcgttttccacctgtggctgtcacctctctgttttttccttgttctatgggacagcttttggggtgtacattagttctgctgttgctgagtcttcccgaattactgctgtggcttcagtgatgtacactgtggtccctcaaatgatgaaccccttcatctacagcctgagaaataaggagatgaagaaagctttgaggaaacttattggtaggctgtttcctttttag

SEQ ID NO: 293 - protein, 345 aa, Homo sapiens
MPMQLLLTDFIIFSIRFIINSMEARNQTAISKFLLLGLIEDPELQPVLFSLFLSMYLVTILGNLLILLAVISDSHLHTPMYFFLSNLSFLDICLSTTTIPKMLVNIQAQNRSITYSGCLTQICFVLFFAGLENCLLAAMAYDRYVAICHPLRYTVIMNPRLCGLLILLSLLTSVVNALLLSLMVLRLSFCTDLEIPLFFCELAQVIQLTCSDTLINNILIYFAACIFGGVPLSGIILSYTQITSCVLRMPSASGKHKAVSTCGSHLSIVLLFYGAGLGVYISSVVTDSPRKTAVASVMYSVFPQMVNPFIYSLRNKDMKGTLRKFIGRIPSLLWCAICFGFRFLE

SEQ ID NO: 294 - DNA, 1038 bp, Homo sapiens
atgccgatgcagctgctgcttacagattttattatcttttccatcagattcatcatcaacagcatggaagcgagaaaccaaacagctatttcaaaattccttctcctgggactgatagaggatccggaactgcagcccgtccttttcagcctgttcctgtccatgtacttggtcaccatcctggggaacctgctcatcctcttggctgtcatctctgactctcacctccacacccccatgtacttcttcctctccaatctctcctttttggacatttgtttaagcacaaccacgatcccaaagatgctggtgaacatccaagctcagaatcggagcatcacgtactcaggctgcctcacccagatctgctttgtcttgttttttgctggcttggaaaattgtctccttgcagcaatggcctatgaccgctatgtggccatttgtcacccccttagatacacagtcatcatgaacccccgcctctgtggcctgctgattcttctctctctgttgactagtgttgtgaatgcccttcttctcagcctgatggtgttgaggctgtccttctgcacagacctggaaatcccgctcttcttctgtgaactggctcaggtcatccaactcacctgttcagacaccctcatcaataacatcctgatatattttgcagcttgcatatttggtggtgttcctctgtctggaatcattttgtcttacactcagatcacctcctgtgttttgagaatgccatcagcaagtggaaagcacaaagcagtttccacctgtgggtctcacctctccattgttctcttgttctatggggcaggtttgggggtgtacattagttctgtggttactgactcacctaggaagactgcagtggcttcagtgatgtattctgtgttccctcaaatggtgaacccctttatctatagtctgaggaataaggacatgaaaggaaccttgaggaagttcatagggaggataccttctcttctgtggtgtgccatttgctttggattcaggtttctagagtaa

SEQ ID NO: 295 - protein, 313 aa, Homo sapiens
MEPRNQTSASQFILLGLSEKPEQETLLFSLFFCMYLVMVVGNLLIILAISIDSHLHTPMYFFLANLSLVDFCLATNTIPKMLVSLQTGSKAISYPCCLIQMYFFHFFGIVDSVIIAMMAYDRFVAICHPLHYAKIMSLRLCRLLVGALWAFSCFISLTHILLMARLVFCGSHEVPHYFCDLTPILRLSCTDTSVNRIFILIVAGMVIATPFVCILASYARILVAIMKVPSAGGRKKAFSTCSSHLSVVALFYGTTIGVYLCPSSVLTTVKEKASAVMYTAVTPMLNPFIYSLRNRDLKGALRKLVNRKITSSS

SEQ ID NO: 296 - DNA, 942 bp, Homo sapiens
atggaaccaagaaaccaaaccagtgcatctcaattcatcctcctgggactctcagaaaagccagagcaggagacgcttctcttttccctgttcttctgcatgtacctggtcatggtcgtggggaacctgctcatcatcctggccatcagcatagactcccacctccacacccccatgtacttcttcctggccaacctgtccctggttgatttctgtctggccaccaacaccatccctaagatgctggtgagccttcaaaccgggagcaaggccatctcttatccctgctgcctgatccagatgtacttcttccatttctttggcatcgtggacagcgtcataatcgccatgatggcttatgaccggttcgtggccatctgccacccattgcactacgccaagatcatgagcctacgcctctgtcgcctgctggtcggcgccctctgggcgttttcctgcttcatctcactcactcacatcctcctgatggcccgtctcgttttctgcggcagccatgaggtgcctcactacttctgcgacctcactcccatcctccgactttcgtgcacggacacctctgtgaataggatcttcatcctcattgtggcagggatggtgatagccacgccctttgtctgcatcctggcctcctatgctcgcatccttgtggccatcatgaaggtcccctctgcaggcggcaggaagaaagccttctccacctgcagctcccacctgtctgtggttgctctcttctatgggaccaccattggcgtctatctgtgtccctcctcggtcctcaccactgtgaaggagaaagcttctgcggtgatgtacacagcagtcacccccatgctgaatcccttcatctacagcttgaggaacagagacctgaaaggggctctcaggaagctggtcaacagaaagatcacctcatcttcctga

SEQ ID NO: 297 - protein, 317 aa, Homo sapiens
MMRLMKEVRGRNQTEVTEFLLLGLSDNPDLQGVLFALFLLIYMANMVGNLGMIVLIKIDLCLHTPMYFFLSSLSFVDASYSSSVTPKMLVNLMAENKAISFHGCAAQFYFFGSFLGTECFLLAMMAYDRYAAIWNPLLYPVLVSGRICFLLIATSFLAGCGNAAIHTGMTFRLSFCGSNRINHFYCDTPPLLKLSCSDTHFNGIVIMAFSSFIVISCVMIVLISYLCIFIAVLKMPSLEGRHKAFSTCASYLMAVTIFFGTILFMYLRPTSSYSMEQDKVVSVFYTVIIPVLNPLIYSLKNKDVKKALKKILWKHIL

SEQ ID NO: 298 - DNA, 954 bp, Homo sapiens
atgatgagacttatgaaagaggttcgaggcagaaatcaaacagaagtaacagaatttctcctcttaggactttccgacaatccagatctacaaggagtcctctttgcattgtttctgttgatctatatggcaaacatggtgggcaatttggggatgattgtattgattaagattgatctctgtctccacacccccatgtatttctttctcagtagcctctcttttgtagatgcctcttactcttcttccgtcactcccaagatgctggtgaacctcatggctgagaataaggccatttcttttcatggatgtgctgcccagttctacttctttggctccttcctggggactgagtgcttcctgttggccatgatggcatatgaccgctatgcagccatttggaaccccctgctctacccagttctcgtgtctgggagaatttgctttttgctaatagctacctccttcttagcaggttgtggaaatgcagccatacatacagggatgacttttaggttgtccttttgtggttctaataggatcaaccatttctactgtgacaccccgccactgctcaaactctcttgctctgatacccacttcaatggcattgtgatcatggcattctcaagttttattgtcatcagctgtgttatgattgtcctcatttcctacctgtgtatcttcattgccgtcttgaagatgccttcgttagagggcaggcacaaagccttctccacctgtgcctcttacctcatggctgtcaccatattctttggaacaatcctcttcatgtacttgcgccctacatctagctactcaatggagcaagacaaggttgtctctgtcttttatacagtaataatccctgtgctaaatcccctcatctatagtttaaaaaataaggatgtaaaaaaggccctaaagaagatcttatggaaacacatcttgtag

SEQ ID NO: 299 - protein, 305 aa, Homo sapiens
MQRSNHTVTEFILLGFTTDPGMQLGLFVVFLGVYSLTVVGNSTLIVLICNDSCLHTPMYFFTGNLSFLDLWYSSVYTPKILVTCISEDKSISFAGCLCQFFFSAGLAYSECYLLAAVAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSKGYLKAFSTCSSHLTSVTLYYGSILYIYALPRSSYSFDMDKIVSTFYTVVFPMLNLMIYSLRNKDVKEALKKLLP

SEQ ID NO: 300 - DNA, 918 bp, Homo sapiens
atgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttttcactggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataa

SEQ ID NO: 301 - protein, 328 aa, Homo sapiens
MFLTERNTTSEATFTLLGFSDYLELQIPLFFVFLAVYGFSVVGNLGMIVIIKINPKLHTPMYFFLNHLSFVDFCYSSIIAPMMLVNLVVEDRTISFSGCLVQFFFFCTFVVTELILFAVMAYDHFVAICNPLLYTVAISQKLCAMLVVVLYAWGVACSLTLACSALKLSFHGFNTINHFFCELSSLISLSYPDSYLSQLLLFTVATFNEISTLLIILTSYAFIIVTTLKMPSASGHRKVFSTCASHLTAITIFHGTILFLYCVPNSKNSRHTVKVASVFYTVVIPLLNPLIYSLRNKDVKDAIRKIINTKYFHIKHRHWYPFNFVIEQ

SEQ ID NO: 302 - DNA, 987 bp, Homo sapiens
atgtttctgacagagagaaatacgacatctgaggccacattcactctcttgggcttctcagattacctggaactgcaaattcccctcttctttgtatttctggcagtctacggcttcagtgtggtagggaatcttgggatgatagtgatcatcaaaattaacccaaaattgcatacccccatgtattttttcctcaaccacctctcctttgtggatttctgctattcctccatcattgctcccatgatgctggtgaacctggttgtagaagatagaaccatttcattctcaggatgtttggtgcaattctttttcttttgcacctttgtagtgactgaattaattctatttgcggtgatggcctatgaccactttgtggccatttgcaatcctctgctctacacagttgccatctcccagaaactctgtgccatgctggtggttgtattgtatgcatggggagtcgcatgttccctgacactcgcgtgctctgctttaaagttatcttttcatggtttcaacacaatcaatcatttcttctgtgagttatcctccctgatatcactctcttaccctgactcttatctcagccagttgcttcttttcactgttgccacttttaatgagataagcacactactcatcattctgacatcttatgcattcatcattgtcaccaccttgaagatgccttcagccagtgggcaccgcaaagtcttctccacctgtgcctcccacctgactgccatcaccatcttccatggcaccatcctcttcctctactgtgtacccaactccaaaaactccaggcacacagtcaaagtggcctctgtgttttacaccgtggtgatccccttgttgaatcccctgatctacagtctgagaaataaagatgttaaggatgcaatccgaaaaataatcaatacaaaatattttcatattaaacataggcattggtatccatttaattttgttattgaacaataa

SEQ ID NO: 303 - protein, 324 aa, Homo sapiens
MAVGRNNTIVTKFILLGLSDHPQMKIFLFMLFLGLYLLTLAWNLSLIALIKMDSHLHMPMYFFLSNLSFLDICYVSSTAPKMLSDIITEQKTISFVGCATQYFVFCGMGLTECFLLAAMAYDRYAAICNPLLYTVLISHTLCLKMVVGAYVGGFLSSFIETYSVYQHDFCGPYMINHFFCDLPPVLALSCSDTFTSEVVTFIVSVVVGIVSVLVVLISYGYIVAAVVKISSATGRTKAFSTCASHLTAVTLFYGSGFFMYMRPSSSYSLNRDKVVSIFYALVIPVVNPIIYSFRNKEIKNAMRKAMERDPGISHGGPFIFMTLG

SEQ ID NO: 304 - DNA, 975 bp, Homo sapiens
atggctgtaggaaggaacaacacaattgtgacaaaattcattctcctgggactttcagaccatcctcaaatgaagattttccttttcatgttatttctggggctctacctcctgacgttggcctggaacttaagcctcattgccctcattaagatggactctcacctgcacatgcccatgtacttcttcctcagtaacctgtccttcctggacatctgctatgtgtcctccaccgcccctaagatgctgtctgacatcatcacagagcagaaaaccatttcctttgttggctgtgccactcagtactttgtcttctgtgggatggggctgactgaatgctttctcctggcagctatggcctatgaccggtatgctgcaatctgcaaccccttgctttacacagtcctcatatcccatacactttgtttaaagatggtggttggcgcctatgtgggtggattccttagttctttcattgaaacatactctgtctatcagcatgatttctgtgggccctatatgatcaaccactttttctgtgacctccctccagtcctggctctgtcctgctctgataccttcaccagcgaggtggtgaccttcatagtcagtgttgtcgttggaatagtgtctgtgctagtggtcctcatctcttatggttacattgttgctgctgttgtgaagatcagctcagctacaggtaggacaaaggccttcagcacttgtgcctctcacctgactgctgtgaccctcttctatggttctggattcttcatgtacatgcgacccagttccagctactccctaaacagggacaaggtggtgtccatattctatgccttggtgatccccgtggtgaatcccatcatctacagttttaggaataaggagattaaaaatgccatgaggaaagccatggaaagggaccccgggatttctcacggtggaccattcatttttatgaccttgggctaa

SEQ ID NO: 305 - protein, 311 aa, Homo sapiens
MEMENCTRVKEFIFLGLTQNREVSLVLFLFLLLVYVTTLLGNLLIMVTVTCESRLHTPMYFLLHNLSIADICFSSITVPKVLVDLLSERKTISFNHCFTQMFLFHLIGGVDVFSLSVMALDRYVAISKPLHYATIMSRDHCIGLTVAAWLGGFVHSIVQISLLLPLPFCGPNVLDTFYCDVHRVLKLAHTDIFILELLMISNNGLLTTLWFFLLLVSYIVILSLPKSQAGEGRRKAISTCTSHITVVTLHFVPCIYVYARPFTALPMDKAISVTFTVISPLLNPLIYTLRNHEMKSAMRRLKRRLVPSDRK

SEQ ID NO: 306 - DNA, 936 bp, Homo sapiens
atggagatggaaaactgcaccagggtaaaagaatttattttccttggcctgacccagaatcgggaagtgagcttagtcttatttcttttcctactcttggtgtatgtgacaactttgctgggaaacctcctcatcatggtcactgttacctgtgaatctcgccttcacacgcccatgtattttttgctccataatttatctattgccgatatctgcttctcttccatcacagtgcccaaggttctggtggaccttctgtctgaaagaaagaccatctccttcaatcattgcttcactcagatgtttctattccaccttattggaggggtggatgtattttctctttcggtgatggcattggatcgatatgtggccatctccaagcccctgcactatgcgactatcatgagtagagaccattgcattgggctcacagtggctgcctggttggggggctttgtccactccatcgtgcagatttccctgttgctcccactccctttctgcggacccaatgttcttgacactttctactgtgatgtccaccgggtcctcaaactggcccatacagacattttcatacttgaactactaatgatttccaacaatggactgctcaccacactgtggtttttcctgctcctggtgtcctacatagtcatattatcattacccaagtctcaggcaggagagggcaggaggaaagccatctccacctgcacctcccacatcactgtggtgaccctgcatttcgtgccctgcatctatgtctatgcccggcccttcactgccctccccatggataaggccatctctgtcaccttcactgtcatctcccctctgctcaaccccttgatctacactctgaggaaccatgagatgaagtcagccatgaggagactgaagagaagacttgtgccttctgatagaaaatag

SEQ ID NO: 307 - protein, 315 aa, Homo sapiens
MSITKAWNSSSVTMFILLGFTDHPELQALLFVTFLGIYLTTLAWNLALIFLIRGDTHLHTPMYFFLSNLSFIDICYSSAVAPNMLTDFFWEQKTISFVGCAAQFFFFVGMGLSECLLLTAMAYDRYAAISSPLLYPTIMTQGLCTRMVVGAYVGGFLSSLIQASSIFRLHFCGPNIINHFFCDLPPVLALSCSDTFLSQVVNFLVVVTVGGTSFLQLLISYGYIVSAVLKIPSAEGRWKACNTCASHLMVVTLLFGTALFVYLRPSSSYLLGRDKVVSVFYSLVIPMLNPLIYSLRNKEIKDALWKVLERKKVFS

SEQ ID NO: 308 - DNA, 948 bp, Homo sapiens
atgtccataaccaaagcctggaacagctcatcagtgaccatgttcatcctcctgggattcacagaccatccagaactccaggccctcctctttgtgaccttcctgggcatctatcttaccaccctggcctggaacctggccctcatttttctgatcagaggtgacacccatctgcacacacccatgtacttcttcctaagcaacttatctttcattgacatctgctactcttctgctgtggctcccaatatgctcactgacttcttctgggagcagaagaccatatcatttgtgggctgtgctgctcagttttttttctttgtcggcatgggtctgtctgagtgcctcctcctgactgctatggcatacgaccgatatgcagccatctccagcccccttctctaccccactatcatgacccagggcctctgtacacgcatggtggttggggcatatgttggtggcttcctgagctccctgatccaggccagctccatatttaggcttcacttttgcggacccaacatcatcaaccacttcttctgcgacctcccaccagtcctggctctgtcttgctctgacaccttcctcagtcaagtggtgaatttcctcgtggtggtcactgtcggaggaacatcgttcctccaactccttatctcctatggttacatagtgtctgcggtcctgaagatcccttcagcagagggccgatggaaagcctgcaacacgtgtgcctcgcatctgatggtggtgactctgctgtttgggacagcccttttcgtgtacttgcgacccagctccagctacttgctaggcagggacaaggtggtgtctgttttctattcattggtgatccccatgctgaaccctctcatttacagtttgaggaacaaagagatcaaggatgccctgtggaaggtgttggaaaggaagaaagtgttttcttag

SEQ ID NO: 309 - protein, 311 aa, Homo sapiens
MEKINNVTEFIFWGLSQSPEIEKVCFVVFSFFYIIILLGNLLIMLTVCLSNLFKSPMYFFLSFLSFVDICYSSVTAPKMIVDLLAKDKTISYVGCMLQLLGVHFFGCTEIFILTVMAYDRYVAICKPLHYMTIMNRETCNKMLLGTWVGGFLHSIIQVALVVQLPFCGPNEIDHYFCDVHPVLKLACTETYIVGVVVTANSGTIALGSFVILLISYSIILVSLRKQSAEGRRKALSTCGSHIAMVVIFFGPCTFMYMRPDTTFSEDKMVAVFYTIITPMLNPLIYTLRNAEVKNAMKKLWGRNVFLEAKGK

SEQ ID NO: 310 - DNA, 936 bp, Homo sapiens
atggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgcttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatag

SEQ ID NO: 311 - protein, 310 aa, Homo sapiens
MMDNHSSATEFHLLGFPGSQGLHHILFAIFFFFYLVTLMGNTVIIVIVCVDKRLQSPMYFFLSHLSTLEILVTTIIVPMMLWGLLFLGCRQYLSLHVSLNFSCGTMEFALLGVMAVDRYVAVCNPLRYNIIMNSSTCIWVVIVSWVFGFLSEIWPIYATFQFTFRKSNSLDHFYCDRGQLLKLSCDNTLLTEFILFLMAVFILIGSLIPTIVSYTYIISTILKIPSASGRRKAFSTFASHFTCVVIGYGSCLFLYVKPKQTQGVEYNKIVSLLVSVLTPFLNPFIFTLRNDKVKEALRDGMKRCCQLLKD

SEQ ID NO: 312 - DNA, 933 bp, Homo sapiens
atgatggacaaccactctagtgccactgaattccaccttctaggcttccctgggtcccaaggactacaccacattctttttgctatattctttttcttctatttagtgacattaatgggaaacacggtcatcattgtgattgtctgtgtggataaacgtctgcagtcccccatgtatttcttcctcagccacctctctaccctggagatcctggtcacaaccataattgtccccatgatgctttggggattgctcttcctgggatgcagacagtatctttctctacatgtatcgctcaacttttcctgtgggaccatggagtttgcattacttggagtgatggctgtggaccgttatgtggctgtgtgtaaccctttgaggtacaacatcattatgaacagcagtacctgtatttgggtggtaatagtgtcatgggtgtttggatttctttctgaaatctggcccatctatgccacatttcagtttaccttccgcaaatcaaattcattagaccatttttactgtgaccgagggcaattgctcaaactgtcctgcgataacactcttctcacagagtttatccttttcttaatggctgtttttattctcattggttctttgatccctacgattgtctcctacacctacattatctccaccatcctcaagatcccgtcagcctctggccggaggaaagccttctccacttttgcctcccacttcacctgtgttgtgattggctatggcagctgcttgtttctctacgtgaaacccaagcaaacacagggagttgagtacaataagatagtttccctgttggtttctgtgttaacccccttcctgaatcctttcatctttactcttcggaatgacaaagtcaaagaggccctccgagatgggatgaaacgctgctgtcaactcctgaaagattag

SEQ ID NO: 313 - protein, 399 aa, Homo sapiens
MSFTSLIPSLCFSLTLPFLFCYLSLLPFLSAFLFITRWLLAFLSLFSVSVPVSSVSSSMVLCLYLSVSASPSVFCFSCMQGPILWIMANLSQPSEFVLLGFSSFGELQALLYGPFLMLYLLAFMGNTIIIVMVIADTHLHTPMYFFLGNFSLLEILVTMTAVPRMLSDLLVPHKVITFTGCMVQFYFHFSLGSTSFLILTDMALDRFVAICHPLRYGTLMSRAMCVQLAGAAWAAPFLAMVPTVLSRAHLDYCHGDVINHFFCDNEPLLQLSCSDTRLLEFWDFLMALTFVLSSFLVTLISYGYIVTTVLRIPSASSCQKAFSTCGSHLTLVFIGYSSTIFLYVRPGKAHSVQVRKVVALVTSVLTPFLNPFILTFCNQTVKTVLQGQMQRLKGLCKAQ

SEQ ID NO: 314 - DNA, 1200 bp, Homo sapiens
atgtctttcacttctctcataccctcactctgtttctccttgactctcccattcctgttttgttatctttctttattgccgtttctttctgcttttctgtttatcactcgctggctacttgcctttctctctctattctctgtctctgtccctgtttcttctgtttcaagttcaatggttctctgtctctatctctctgtttctgcctctccgtctgtcttttgtttctcttgcatgcagggccccatactgtggatcatggcaaatctgagccagccctccgaatttgtcctcttgggcttctcctcctttggtgagctgcaggcccttctgtatggccccttcctcatgctttatcttctcgccttcatgggaaacaccatcatcatagttatggtcatagctgacacccacctacatacacccatgtacttcttcctgggcaatttttccctgctggagatcttggtaaccatgactgcagtgcccaggatgctctcagacctgttggtcccccacaaagtcattaccttcactggctgcatggtccagttctacttccacttttccctggggtccacctccttcctcatcctgacagacatggcccttgatcgctttgtggccatctgccacccactgcgctatggcactctgatgagccgggctatgtgtgtccagctggctggggctgcctgggcagctcctttcctagccatggtacccactgtcctctcccgagctcatcttgattactgccatggcgacgtcatcaaccacttcttctgtgacaatgaacctctcctgcagttgtcatgctctgacactcgcctgttggaattctgggactttctgatggccttgacctttgtcctcagctccttcctggtgaccctcatctcctatggctacatagtgaccactgtgctgcggatcccctctgccagcagctgccagaaggctttctccacttgcgggtctcacctcacactggtcttcatcggctacagtagtaccatctttctgtatgtcaggcctggcaaagctcactctgtgcaagtcaggaaggtcgtggccttggtgacttcagttctcaccccctttctcaatccctttatccttaccttctgcaatcagacagttaaaacagtgctacaggggcagatgcagaggctgaaaggcctttgcaaggcacaatga

SEQ ID NO: 315 - protein, 292 aa, Homo sapiens
MVGNLLIWVTTIGSPSLGSLMYFFLAYLSLMDAIYSTAMSPKLMIDLLCDKIAISLSACMGQLFIEHLLGGAEVFLLVVMAYDRYVAISKPLHYLNIMNRLVCILLLVVAMIGGFVHSVVQIVFLYSLPICGPNVIDHSVCDMYPLLELLCLDTYFIGLTVVANGGIICMVIFTFLLISCGVILNFLKTYSQEERHKALPTCISHIIVVALVFVPCIFMYVRPVSNFPFDKLMTVFYSIITLMLNPLIYSLRQSEMKNAMKNLWCEKLSIVRKRVSPTLNIFIPSSKATNRR

SEQ ID NO: 316 - DNA, 879 bp, Homo sapiens
atggtgggaaacctcctcatttgggtgactactattggcagcccctccttgggctccctaatgtacttcttccttgcctacttgtcacttatggatgccatatattccactgccatgtcacccaaattgatgatagacttactctgtgataaaatcgctatttccttgtcagcttgcatgggtcagctcttcatagaacacttacttggtggtgcagaggtcttccttttggtggtgatggcctatgatcgctatgtggctatctctaagccgctgcactatttgaacatcatgaatcgactggtttgcatccttctgttggtggtggccatgattggaggttttgtgcactctgtggttcaaattgtctttctgtacagtctaccaatctgtggccccaatgttattgaccactctgtctgtgacatgtacccattgttggaactgttgtgccttgacacctactttataggactcactgtggttgccaatggtggaataatttgtatggtcatctttacctttctgctaatctcctgtggagtcatcctaaacttccttaaaacttacagtcaggaagagaggcataaagccctgcctacctgcatctcccacatcattgtggttgccctcgtttttgttccctgtatttttatgtatgttagacccgtttccaactttccctttgataaattaatgactgtgttttattcaattatcacactcatgttgaatcctttaatatactcgttgagacaatcagagatgaaaaatgctatgaaaaatctctggtgtgaaaagttaagtatagttagaaaaagagtatctcccacactgaacatatttattcctagttctaaggcaacaaataggcggtaa

SEQ ID NO: 317 - protein, 320 aa, Homo sapiens [sequence omitted]

SEQ ID NO: 318 - DNA, 963 bp, Homo sapiens
atggcagaaactctacaactcaattccaccttcctacacccaaacttcttcatactgactggctttccagggctaggaagtgcccagacttggctgacactggtctttgggcccatttatctgctggccctgctgggcaatggagcactgccggcagtggtgtggatagactccacactgcaccagcccatgtttctactgttggccatcctggcagccacagacctgggcttagccacatctatagccccagggttgctggctgtgctgtggcttgggccccgatctgtgccatatgctgtgtgcctggtccagatgttctttgtacatgcactgactgccatggaatcaggtgtgcttttggccatggcctgtgatcgtgctgcggcaatagggcgtccactgcactaccctgtcctggtcaccaaagcctgtgtgggttatgcagccttggccctggcactgaaagctgtggctattgttgtacctttcccactgctggtggcaaagtttgagcacttccaagccaagaccataggccatacctattgtgcacacatggcagtggtagaactggtggtgggtaacacacaggccaccaacttatatggtctggcactttcactggccatctcaggtatggatattctgggtatcactggctcctatggactcattgcccatgctgtgctgcagctacctacccgggaggcccatgccaaggcctttggtacatgtagttctcacatctgtgtcattctggccttctacatacctggtctcttctcctacctcgcacaccgctttggtcatcacactgtcccaaagcctgtgcacatccttctctccaacatctacttgctgctgccacctgccctcaaccccctcatctatggggcccgcaccaagcagatcagagaccgactcctggaaaccttcacattcagaaaaagcccgttgtaa

SEQ ID NO: 319 - protein, 323 aa, Homo sapiens
MSHTNVTIFHPAVFVLPGIPGLEAYHIWLSIPLCLIYITAVLGNSILIVVIVMERNLHVPMYFFLSMLAVMDILLSTTTVPKALAIFWLQAHNIAFDACVTQGFFVHMMFVGESAILLAMAFDRFVAICAPLRYTTVLTWPVVGRIALAVITRSFCIIFPVIFLLKRLPFCLTNIVPHSYCEHIGVARLACADITVNIWYGFSVPIVMVILDVILIAVSYSLILRAVFRLPSQDARHKALSTCGSHLCVILMFYVPSFFTLLTHHFGRNIPQHVHILLANLYVAVPPMLNPIVYGVKTKQIREGVAHRFFDIKTWCCTSPLGS

SEQ ID NO: 320 - DNA, 972 bp, Homo sapiens
atgagtcacaccaatgttaccatcttccatcctgcagtttttgtccttcctggcatccctgggttggaggcttatcacatttggctgtcaatacctctttgcctcatttacatcactgcagtcctgggaaacagcatcctgatagtggttattgtcatggaacgtaaccttcatgtgcccatgtatttcttcctctcaatgctggccgtcatggacatcctgctgtctaccaccactgtgcccaaggccctagccatcttttggcttcaagcacataacattgcttttgatgcctgtgtcacccaaggcttctttgtccatatgatgtttgtgggggagtcagctatcctgttagccatggcctttgatcgctttgtggccatttgtgccccactgagatatacaacagtgctaacatggcctgttgtggggaggattgctctggccgtcatcacccgaagcttctgcatcatcttcccagtcatattcttgctgaagcggctgcccttctgcctaaccaacattgttcctcactcctactgtgagcatattggagtggctcgtttagcctgtgctgacatcactgttaacatttggtatggcttctcagtgcccattgtcatggtcatcttggatgttatcctcatcgctgtgtcttactcactgatcctccgagcagtgtttcgtttgccctcccaggatgctcggcacaaggccctcagcacttgtggctcccacctctgtgtcatccttatgttttatgttccatccttctttaccttattgacccatcattttgggcgtaatattcctcaacatgtccatatcttgctggccaatctttatgtggcagtgccaccaatgctgaaccccattgtctatggtgtgaagactaagcagatacgtgagggtgtagcccaccggttctttgacatcaagacttggtgctgtacctcccctctgggctcatga

SEQ ID NO: 321 - protein, 345 aa, Homo sapiens
MHFLSQNDLNINLIPHLCLHRHSVIAGAFTIHRHMKIFNSPSNSSTFTGFILLGFPCPREGQILLFVLFTVVYLLTLMGNGSIICAVHWDQRLHAPMYILLANFSFLEICYVTSTVPSMLANFLSDTKIISFSGCFLQFYFFFSLGSTECFFLAVMAFDRYLAICRPLRYPTIMTRRLCTNLVVNCWVLGFIWFLIPIVNISQMSFCGSRIIDHFLCDPAPLLTLTCKKGPVIELVFSVLSPLPVFMLFLFIVGSYALVVRAVLRVPSAAGRRKAFSTCGSHLAVVSLFYGSVLVMYGSPPSKNEAGKQKTVTLFYSVVTPLLNPVIYSLRNKDMRKALKKFWGT

SEQ ID NO: 322 - DNA, 1038 bp, Homo sapiens
atgcattttctttcccaaaatgatttaaatataaatctgattccccatctatgtttgcaccgtcattcagtaattgctggtgcttttacaattcacaggcacatgaaaatcttcaacagccccagcaactccagcaccttcactggcttcatcctcctgggcttcccttgccccagggaggggcagatcctcctctttgtgctcttcactgttgtttacctcctgaccctcatgggcaatggttccatcatctgtgctgtgcactgggatcagagactccacgcccccatgtacatcctgctcgccaacttctccttcttggagatatgttatgtcacctccacagtccccagcatgctggccaacttcctctctgacaccaagatcatctcgttctctggctgcttcctccagttctactttttcttctccttgggctctacagaatgctttttcctggcagttatggcatttgatcgataccttgccatctgtcggcctctacgctatccaaccattatgaccagacgtctctgtaccaatcttgtggtcaattgctgggtacttggtttcatctggttcttgattcctatcgtcaacatctcccaaatgtccttctgtggatctaggattattgaccacttcctatgtgacccagctcctcttctaactctcacttgcaaaaaaggccctgtgatagagcttgtcttttctgtcttaagtcctctgcctgtctttatgctctttctcttcattgtggggtcctatgctctggtcgtgagagctgtgttgagggtcccttcagcagctgggagaagaaaggctttctccacctgtgggtctcacctggctgtggtttcactgttctacggctcagtactggtcatgtatgggagcccaccatctaagaatgaagctggaaagcagaagactgtgactctgttttattctgttgttaccccactgcttaaccctgtgatatatagtcttaggaacaaagatatgagaaaagctctgaagaaattttggggaacataa

SEQ ID NO: 323 - protein, 330 aa, Homo sapiens
MFFIIHSLVTSVFLTALGPQNRTMHFVTEFVLLGFHGQREMQSCFFSFILVLYLLTLLGNGAIVCAVKLDRRLHTPMYILLGNFAFLEIWYISSTVPNMLVNILSEIKTISFSGCFLQFYFFFSLGTTECFFLSVMAYDRYLAICRPLHYPSIMTGKFCIILVCVCWVGGFLCYPVPIVLISQLPFCGPNIIDHLVCDPGPLFALACISAPSTELICYTFNSMIIFGPFLSILGSYTLVIRAVLCIPSGAGRTKAFSTCGSHLMVVSLFYGTLMVMYVSPTSGNPAGMQKIITLVYTAMTPFLNPLIYSLRNKDMKDALKRVLGLTVSQN

SEQ ID NO: 324 - DNA, 993 bp, Homo sapiens
atgttctttattattcattctttggttacttctgtttttctaacagctttgggaccccagaacagaacaatgcattttgtgactgagtttgtcctcctgggtttccatggtcaaagggagatgcagagctgcttcttctcattcatcctggttctctatctcctgacactgctagggaatggagctattgtctgtgcagtgaaattggacaggcggctccacacacccatgtacatccttctgggaaactttgcctttctagagatctggtacatttcctccactgtcccaaacatgctagtcaatatcctctctgagattaaaaccatctccttctctggttgcttcctgcaattctatttctttttttcactgggtacaacagagtgtttctttttatcagttatggcttatgatcggtacctggccatctgtcgtccattacactacccctccatcatgactgggaagttctgtataattctggtctgtgtatgctgggtaggcggatttctctgctatccagtccctattgttcttatctcccaacttcccttctgtgggcccaacatcattgaccacttggtgtgtgacccaggcccattgtttgcactggcctgcatctctgctccttccactgagcttatctgttacaccttcaactcgatgattatctttgggcccttcctctccatcttgggatcttacactctggtcatcagagctgtgctttgtattccctctggtgctggtcgaactaaagctttctccacatgtgggtcccacctaatggtggtgtctctattctatggaacccttatggtgatgtatgtgagcccaacatcagggaacccagcaggaatgcagaagatcatcactctggtatacacagcaatgactccattcttaaatccccttatctatagtcttcgaaacaaagacatgaaagatgctctaaagagagtcctggggttaacagttagccaaaactga

SEQ ID NO: 325 - protein, 324 aa, Homo sapiens
MSFFFVDLRPMNRSATHIVTEFILLGFPGCWKIQIFLFSLFLVIYVLTLLGNGAIIYAVRCNPLLHTPMYFLLGNFAFLEIWYVSSTIPNMLVNILSKTKAISFSGCFLQFYFFFSLGTTECLFLAVMAYDRYLAICHPLQYPAIMTVRFCGKLVSFCWLIGFLGYPIPIFYISQLPFCGPNIIDHFLCDMDPLMALSCAPAPITECIFYTQSSLVLFFTSMYILRSYILLLTAVFQVPSAAGRRKAFSTCGSHLVVVSLFYGTVMVMYVSPTYGIPTLLQKILTLVYSVTTPLFNPLIYTLRNKDMKLALRNVLFGMRIRQNS

SEQ ID NO: 326 - DNA, 975 bp, Homo sapiens
atgtctttcttctttgtagacttaagacccatgaacaggtcagcaacacacatcgtgacagagtttattctcctgggattccctggttgctggaagattcagattttcctcttctcattgtttttggtgatttatgtcttgaccttgctgggaaatggagccatcatctatgcagtgagatgcaacccactactacacacccccatgtactttctgctgggaaattttgccttccttgagatctggtatgtgtcctccactattcctaacatgctagtcaacattctctccaagaccaaggccatctcattttctgggtgcttcctccagttctatttcttcttttcactgggaacaactgaatgtctctttctggcagtaatggcttatgatcgatacctggccatctgccacccactgcagtaccctgccatcatgactgtaaggttctgtggtaagctggtgtctttctgttggcttattggattccttggatacccaattcccattttctacatctcccaactccccttctgtggtcctaatatcattgatcacttcctgtgtgacatggacccattgatggctctatcctgtgccccagctcccataactgaatgtattttctatactcagagctcccttgtcctctttttcactagtatgtacattcttcgatcctatatcctgttactaacagctgtttttcaggtcccttctgcagctggtcggagaaaagccttctctacctgtggttctcatttggttgtggtatctcttttctatgggacagtcatggtaatgtatgtaagtcctacatatgggatcccaactttattgcagaagatcctcacactggtatattcagtaacgactcctctttttaatcctctgatctatactcttcgtaataaggacatgaaactcgctctgagaaatgtcctgtttggaatgagaattcgtcaaaattcgtga

SEQ ID NO: 327 - protein, 291 aa, Homo sapiens
MVGANHSVVSEFVFLGLTNSWEIRLLLLVFSSMFYMASMMGNSLILLTVTSDPHLHSPMYFLLANLSFIDLGVSSVTSPKMIYDLFRKHEVISFGGCIAQIFFIHVIGGVEMVLLIAMAFDRYVAICKPLQYLTIMSPRMCMFFLVAAWVTGLIHSVVQLVFVVNLPFCGPNVSDSFYCDLPRFIKLACTDSYRLEFMVTANSGFISLGSFFILIISYVVIILTVLKHSSAGLSKALSTLSAHVSVVVLFFGPLIFVYTWPSPSTHLDKFLAIFDAVLTPVLNPIIYTFRN

SEQ ID NO: 328 - DNA, 876 bp, Homo sapiens
atggttggggcaaatcactccgtggtgtcagagtttgtgttcctgggactcaccaattcctgggagatccgacttctcctccttgtgttctcctccatgttttacatggccagtatgatgggaaactctctcattttgctcactgtgacttctgaccctcacttgcactcccccatgtattttctgttagccaacctctccttcattgacctgggtgtttcctctgtcacttctcccaaaatgatttatgacctgttcagaaagcacgaagtcatctcctttggaggctgcatcgctcaaatcttcttcatccacgtcattggcggtgtggagatggtgctgctcatagccatggcctttgacagatatgtggccatatgtaagcccctccagtacctgaccattatgagcccaagaatgtgcatgttcttcttagtggctgcctgggtgaccggccttatccactctgtagttcaattggtttttgtagtaaacttgcccttctgtggtcctaatgtatcggacagcttttactgtgaccttcctcggttcatcaaacttgcctgcacagacagctaccgactggagttcatggttacagccaacagtggattcatctctctgggctccttcttcatactgatcatttcctatgtggtcatcattctcactgttctgaaacactcttcagctggtttatccaaggctctgtccaccctttcagctcacgtcagtgtggtagttttgttctttggtcctttgatttttgtctatacgtggccatctccctccacacacctggataagtttctggccatctttgatgcagttctcactcctgttttaaatcctatcatctacacattcaggaattga

SEQ ID NO: 329 - protein, 312 aa, Homo sapiens
MNGMNHSVVSEFVFMGLTNSREIQLLLFVFSLLFYFASMMGNLVIVFTVTMDAHLHSPMYFLLANLSIIDMAFCSITAPKMICDIFKKHKAISFRGCITQIFFSHALGGTEMVLLIAMAFDRYMAICKPLHYLTIMSPRMCLYFLATSSIIGLIHSLVQLVFVVDLPFCGPNIFDSFYCDLPRLLRLACTNTQELEFMVTVNSGLISVGSFVLLVISYIFILFTVWKHSSGGLAKALSTLSAHVTVVILFFGPLMFFYTWPSPTSHLDKYLAIFDAFITPFLNPVIYTFRNKDMKVAMRRLCSRLAHFTKIL

SEQ ID NO: 330 - DNA, 939 bp, Homo sapiens
atgaatggaatgaatcactctgtggtatcagaatttgtattcatgggactcaccaactcacgggagattcagcttctactttttgttttctctttgttgttctactttgcgagcatgatgggaaaccttgtcattgtattcactgtaaccatggatgctcatctgcactcccccatgtatttcctcctggctaacctctcaatcattgatatggcattttgctcaattacagcccctaagatgatttgtgatattttcaagaagcacaaggccatctcctttcggggatgtattactcagatcttctttagccatgctcttgggggcactgagatggtgctgctcatagccatggcctttgacagatacatggccatatgtaaacctctccactacctgaccatcatgagcccaagaatgtgtctatactttttagccacttcctctatcattggccttatccactcattggtccaattagtttttgtggtagatttacctttttgtggtcctaatatctttgacagtttttactgtgatctccctcggctcctcagacttgcctgtaccaacacccaagaactggagttcatggtcactgtcaatagtggactcatttctgtgggctcctttgtcttgctggtaatttcctacatcttcattctgttcactgtttggaaacattcttctggtggtctagccaaggccctctctaccctgtcagctcatgtcactgtggtcatcttgttctttgggccactgatgtttttctacacatggccttctcccacatcacacctggataaatatcttgctatttttgatgcatttattactccttttctgaatccagttatctacacattcaggaacaaagacatgaaagtggcaatgaggagactgtgcagtcgtcttgcgcattttacaaagattttgtaa

SEQ ID NO: 331 - protein, 354 aa, Homo sapiens
MTNKMYAIYIKNLNYFSFLIVQCLQPTMAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 332 - DNA, 1065 bp, Homo sapiens
atgactaataaaatgtatgctatatatataaagaatcttaattatttttctttcctcatagttcagtgtcttcaaccaaccatggcaatattcaataacaccacttcgtcttcctcaaacttcctcctcactgcattccctgggctggaatgtgctcatgtctggatctccattccagtctgctgtctctacaccattgccctcttgggaaacagtatgatctttcttgtcatcattactaagcggagactccacaaacccatgtattatttcctctccatgctggcagctgttgatctatgtctgaccattacgacccttcccactgtgcttggtgttctctggtttcatgcccgggagatcagctttaaagcttgcttcattcaaatgttctttgtgcatgctttctccttgctggagtcctcggtgctggtagccatggcctttgaccgcttcgtggctatctgtaacccactgaactatgctactatcctcacagacaggatggtcctggtgatagggctggtcatctgcattagaccagcagttttcttacttccccttcttgtagccataaacactgtgtcttttcatgggggtcacgagctttcccatccattttgctaccacccagaagtgatcaaatacacatattccaaaccttggatcagcagtttttggggactgtttcttcagctctacctgaatggcactgacgtattgtttattcttttctcctatgtcctgatcctccgtactgttctgggcattgtggcccgaaagaagcaacaaaaagctctcagcacttgtgtctgtcacatctgtgcagtcactattttctatgtgccactgatcagcctctctttggcacaccgcctcttccactccaccccaagggtgctctgtagcactttggccaatatttatctgctcttaccacctgtgctgaaccctatcatttacagcttgaagaccaagacaatccgccaggctatgttccagctgctccaatccaagggttcatggggttttaatgtgaggggtcttaggggaagatgggattga

SEQ ID NO: 333 - protein, 312 aa, Homo sapiens
MSVLNNSEVKLFLLIGIPGLEHAHIWFSIPICLMYLLAIMGNCTILFIIKTEPSLHEPMYYFLAMLAVSDMGLSLSSLPTMLRVFLFNAMGISPNACFAQEFFIHGFTVMESSVLLIMSLDRFLAIHNPLRYSSILTSNRVAKMGLILAIRSILLVIPFPFTLRRLKYCQKNLLSHSYCLHQDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILGKLLNVCGR

SEQ ID NO: 334 - DNA, 939 bp, Homo sapiens
atgtctgttctcaataactccgaagtcaagcttttccttctgattgggatcccaggactggaacatgcccacatttggttctccatccccatttgcctcatgtacctgcttgccatcatgggcaactgcaccattctctttattataaagacagagccctcgcttcatgagcccatgtattatttccttgccatgttggctgtctctgacatgggcctgtccctctcctcccttcctaccatgttgagggtcttcttgttcaatgccatgggaatttcacctaatgcctgctttgctcaagaattcttcattcatggattcactgtcatggaatcctcagtacttctaattatgtctttggaccgctttcttgccattcacaatcccttaagatacagttctatcctcactagcaacagggttgctaaaatgggacttattttagccattaggagcattctcttagtgattccatttcccttcaccttaaggagattaaaatattgtcaaaagaatcttctttctcactcatactgtcttcatcaggataccatgaagctggcctgctctgacaacaagaccaatgtcatctatggcttcttcattgctctctgtactatgctggacttggcactgattgttttgtcttatgtgctgatcttgaagactatactcagcattgcatctttggcagagaggcttaaggccctaaatacctgtgtctcccacatctgtgctgtgctcaccttctatgtgcccatcatcaccctggctgccatgcatcactttgccaagcacaaaagccctcttgttgtgatccttattgcagatatgttcttgttggtgccgccccttatgaaccccattgtgtactgtgtaaagactcgacaaatctgggagaagatcttggggaagttgcttaatgtatgtgggagataa

SEQ ID NO: 335 - protein, 314 aa, Homo sapiens
MTLGSLGNSSSSVSATFLLSGIPGLERMHIWISIPLCFMYLVSIPGNCTILFIIKTERSLHEPMYLFLSMLALIDLGLSLCTLPTVLGIFWVGAREISHDACFAQLFFIHCFSFLESSVLLSMAFDRFVAICHPLHYVSILTNTVIGRIGLVSLGRSVALIFPLPFMLKRFPYCGSPVLSHSYCLHQEVMKLACADMKANSIYGMFVIVSTVGIDSLLILFSYALILRTVLSIASRAERFKALNTCVSHICAVLLFYTPMIGLSVIHRFGKQAPHLVQVVMGFMYLLFPPVMNPIVYSVKTKQIRDRVTHAFCY

SEQ ID NO: 336 - DNA, 945 bp, Homo sapiens
atgaccctgggatccctgggaaacagcagcagcagcgtttctgctaccttcctgctgagtggcatccctgggctggagcgcatgcacatctggatctccatcccactgtgcttcatgtatctggtttccatcccgggcaactgcacaattctttttatcattaaaacagagcgctcacttcatgaacctatgtatctcttcctgtccatgctggctctgattgacctgggtctctccctttgcactctccctacagtcctgggcatcttttgggttggagcacgagaaattagccatgatgcctgctttgctcagctctttttcattcactgcttctccttcctcgagtcctctgtgctactgtctatggcctttgaccgctttgtggctatctgccaccccttgcactatgtttccattctcaccaacacagtcattggcaggattggcctggtctctctgggtcgtagtgtagcactcatttttccattaccttttatgctcaaaagattcccctattgtggctccccagttctctcacattcttattgtctccaccaagaagtgatgaaattggcctgtgccgacatgaaggccaacagcatctacggcatgtttgtcatcgtctctacagtgggtatagactcactgctcatcctcttctcttatgctctgatcctgcgcaccgtgctgtccatcgcctccagggctgagagattcaaggcccttaacacctgtgtttcccacatctgtgctgtgctgctcttctacactcccatgattggcctctctgtcatccatcgctttggaaagcaggcaccccacctggtccaggtggtcatgggtttcatgtatcttctctttcctcctgtgatgaatcccattgtctacagtgtgaagaccaaacagatccgggatcgagtgacgcatgccttttgttactaa

SEQ ID NO: 337 - protein, 302 aa, Homo sapiens
MTNLNASQANHRNFILTGIPGTPDKNPWLAFPLGFLYTLTLLGNGTILAVIKVEPSLHEPTYYFLSILALTDVSLSMSTLPSMLSIYWFNAPQIVFDACIMQMFFIHVFGIVESGVLVSMAFDRFVAIRNPLHYVSILTHDVIRKTGISVLTRAVCVVFPVPFLIKCLPFCHSNVLSHSYCLHQNMMRLACASTRINSLYGLIVVIFTLGLDVLLTLLSYVLTLKTVLGIVSRGERLKTLSTCLSHMSTVLLFYVPFMGAASMIHRFWEHLSPVVHMVMADIYLLLPPVLNPIVYSVKTKQI

SEQ ID NO: 338 - DNA, 909 bp, Homo sapiens
atgacgaacttgaatgcatcacaggccaaccaccgtaacttcattctgacaggtatcccaggaacgccagacaagaacccatggttggcctttcccctgggatttctctacacactcacactcctgggaaatggtaccatcctagctgtcatcaaggtggagccaagtctccatgagcccacgtattacttcctttctatcttggctctcactgacgttagtctctccatgtccaccttgccctccatgctcagcatctactggtttaatgcccctcagattgtttttgatgcatgcatcatgcagatgttcttcatccatgtatttggaatagtagaatcaggagtcctagtgtccatggcctttgacagatttgtggccatccgaaacccattacactatgtttccatcctcactcacgatgttattcgaaagactggaatatctgtcctcacccgggcagtctgtgtggtattccctgtgcccttccttataaagtgcctacccttctgccattccaatgtcttgtctcattcatactgtcttcaccaaaacatgatgcggctagcttgtgccagcacccgcatcaacagcctctacggcctcatcgtcgtcatcttcacactggggctcgatgttctcctcactctactgtcttatgtactcaccctgaagactgtgctgggcattgtctccagaggtgaaaggctgaaaaccctcagcacatgcctctctcacatgtctaccgtgctcctcttctatgttccttttatgggtgctgcctccatgatccacagattttgggagcatttatcaccagtagtgcacatggtcatggctgatatatacctactgctcccgcctgtgctaaaccccattgtctacagtgtgaagaccaagcaaatttga

SEQ ID NO: 339 - protein, 323 aa, Homo sapiens
MSTLPTQIAPNSSTSMAPTFLLVGMPGLSGAPSWWTLPLIAVYLLSALGNGTILWIIALQPALHRPMHFFLFLLSVSDIGLVTALMPTLLGIALAGAHTVPASACLLQMVFIHVFSVMESSVLLAMSIDRALAICRPLHYPALLTNGVISKISLAISFRCLGLHLPLPFLLAYMPYCLPQVLTHSYCLHPDVARLACPEAWGAAYSLFVVLSAMGLDPLLIFFSYGLIGKVLQGVESREDRWKAGQTCAAHLSAVLLFYIPMILLALINHPELPITQHTHTLLSYVHFLLPPLINPILYSVKMKEIRKRILNRLQPRKVGGAQ

SEQ ID NO: 340 - DNA, 972 bp, Homo sapiens
atgtcaacattaccaactcagatagcccccaatagcagcacttcaatggcccccaccttcttgctggtgggcatgccaggcctatcaggtgcaccctcctggtggacattgcccctcattgctgtctaccttctctctgcactgggaaatggcaccatcctctggatcattgccctgcagcccgccctgcaccgcccaatgcacttcttcctcttcttgcttagtgtgtctgatattggattggtcactgccctgatgcccacactgctgggcatcgcccttgctggtgctcacactgtccctgcctcagcctgccttctacagatggtttttatccatgtcttttctgtcatggagtcctctgtcttgctcgccatgtccattgatcgggcactggccatctgccgacctctccactacccagcgctcctcaccaatggtgtaattagcaaaatcagcctggccatttcttttcgatgcctgggtctccatctgcccctgccattcctgctggcctacatgccctactgcctcccacaggtcctaacccattcttattgcttgcatccagatgtggctcgtttggcctgcccagaagcttggggtgcagcctacagcctatttgtggttctttcagccatgggtttggaccccctgcttattttcttctcctatggcctgattggcaaggtgttgcaaggtgtggagtccagagaggatcgctggaaggctggtcaaacctgtgctgcccacctctctgcagtgctcctcttctatatccctatgatcctcctggcactgattaaccatcctgagctgccaatcactcagcatacccatactcttctatcctatgtccatttccttcttcctccattgataaaccctattctctatagtgtcaagatgaaggagattagaaagagaatactcaacaggttgcagcccaggaaggtgggtggtgctcagtga

SEQ ID NO: 341 - protein, 394 aa, Homo sapiens
MFYPILNDISTKNNSNIMSCCNILFIKTVEIILVYNQTQSPWYPIVPSKSLVYNNNTCFDCYHLQRVDCVPSRDHINQSMVLASGNSSSHPVSFILLGIPGLESFQLWIAFPFCATYAVAVVGNITLLHVIRIDHTLHEPMYLFLAMLAITDLVLSSSTQPKMLAIFWFHAHEIQYHACLIQVFFIHAFSSVESGVLMAMALDCYVATCFPLRHSSILTPSVVIKLGTIVMLRGLLWVSPFCFMVSRMPFCQHQAIPQSYCEHMAVLKLVCADTSISRGYGLFVAFSVAGFDMIVIGMSYVMILRAVLQLPSGEARLKAFSTRASHICVILALYIPALFSFLTYRFGHDVPRVVHILFANLYLLIPPMLNPIIYGVRTKQIGDRVIQGCCGNIP

SEQ ID NO: 342 - DNA, 1185 bp, Homo sapiens
atgttctaccccattttgaatgacataagtacgaaaaacaacagtaacatcatgtcatgttgtaacatattatttattaaaacagttgaaattattctagtttataatcaaacccaatcaccctggtatccaatagtcccatccaaaagccttgtatataataataacacttgttttgattgttatcatctgcagagagtagattgcgttcccagcagagaccatattaaccagtccatggtgctggcttcagggaacagctcttctcatcctgtgtccttcatcctgcttggaatcccaggcctggagagtttccagttgtggattgcctttccgttctgtgccacgtatgctgtggctgttgttggaaatatcactctcctccatgtaatcagaattgaccacaccctgcatgagcccatgtacctctttctggccatgctggccatcactgacctggtcctctcctcctccactcaacctaagatgttggccatattctggtttcatgctcatgagattcagtaccatgcctgcctcatccaggtgttcttcatccatgccttttcttctgtggagtctggggtgctcatggctatggccctggactgctacgtggctacctgcttcccactccgacactctagcatcctgaccccatcggtcgtgatcaaactggggaccatcgtgatgctgagagggctgctgtgggtgagccccttctgcttcatggtgtctaggatgcccttctgccaacaccaagccattccccagtcatactgtgagcacatggctgtgctgaagttggtgtgtgctgatacaagcataagtcgtgggtatgggctctttgtggccttctctgtggctggctttgatatgattgtcattggtatgtcatacgtgatgattttgagagctgtgcttcagttgccctcaggtgaagcccgcctcaaagcttttagcacacgtgcctcccatatctgtgtcatcttggctctttatatcccagcccttttttctttcctcacctaccgctttggccatgatgtgccccgagttgtacacatcctgtttgctaatctctatctactgatacctcccatgctcaaccccatcatttatggagttagaaccaaacagatcggggacagggttatccaaggatgttgtggaaacatcccctga

SEQ ID NO: 343 - protein, 311 aa, Homo sapiens
MSNASLVTAFILTGLPHAPGLDALLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATGTWLSGSLHSAVQTILTFHLPYCGPNQIQHYFCDAPPILKLACADTSANVMVIFVDIGIVASGCFVLIVLSYVSIVCSILRIRTSDGRRRAFQTCASHCIVVLCFFVPCVVIYLRPGSMDAMDGVVAIFYTVLTPLLNPVVYTLRNKEVKKAVLKLRDKVAHPQRK

SEQ ID NO: 344 - DNA, 936 bp, Homo sapiens
atgtccaacgccagcctcgtgacagcattcatcctcacaggccttccccatgccccagggctggacgccctcctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcaggtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgtgatggtcatctttgtggacattgggatagtggcctcaggctgctttgtcctgatagtgctgtcctatgtgtccatcgtctgttccatcctgcggatccgcacctcagatgggaggcgcagagcctttcagacctgtgcctcccactgtattgtggtcctttgcttctttgttccctgtgttgtcatttatctgaggccaggctccatggatgccatggatggagttgtggccattttctacactgtgctgacgccccttctcaaccctgttgtgtacaccctgagaaacaaggaggtgaagaaagctgtgttgaaacttagagacaaagtagcacatcctcagaggaaataa

SEQ ID NO: 345 - protein, 335 aa, Homo sapiens
MAQVRALHKIMALFSANSIGAMNNSDTRIAGCFLTGIPGLEQLHIWLSIPFCIMYIAALEGNGILICVILSQAILHEPMYIFLSMLASADVLLSTTTMPKALANLWLGYSHISFDGCLTQKFFIHFLFIHSAVLLAMAFDRYVAICSPLRYVTILTSKVIGKIVTATLSRSFIIMFPSIFLLEHLHYCQINIIAHTFCEHMGIAHLSCSDISINVWYGLAAALLSTGLDIMLITVSYIHILQAVFRLLSQDARSKALSTCGSHICVILLFYVPALFSVFAYRFGGRSIPCYVHILLASLYVVIPPMLNPVIYGVRTKPILEGAKQMFSNLAKGSK

SEQ ID NO: 346 - DNA, 1008 bp, Homo sapiens
atggcacaggtgagggcgctgcataaaatcatggcccttttttctgctaacagcataggtgctatgaacaactctgacactcgcatagcaggctgcttcctcactggcatccctgggctggagcaactacatatctggctgtccatccccttctgcatcatgtacatcgctgccctggaaggcaatggcatcctaatttgtgtcatcctctcccaggcaatcctgcatgagcccatgtacatattcttatctatgctggccagtgctgatgtcttgctctctaccaccaccatgcctaaggccctggccaatttgtggctaggttatagccacatttcctttgatggctgcctcactcaaaagttcttcattcacttcctcttcattcactctgctgtcctgctggccatggcctttgaccgctatgtggccatctgctcccccctgcgatatgtcacaatcctcacaagcaaggtcattgggaagatcgtcactgccaccctgagccgcagcttcatcattatgtttccatccatctttctccttgagcacctgcactattgccagatcaacatcattgcacacacattttgtgagcacatgggcattgcccatctgtcctgttctgatatctccatcaatgtctggtatgggttggcagctgctcttctctccacaggcctggacatcatgcttattactgtttcctacatccacatcctccaagcagtcttccgcctcctttctcaagatgcccgctccaaggccctgagtacctgtggatcccatatctgtgtcatcctactcttctatgtccctgcccttttttctgtctttgcctacaggtttggtgggagaagcatcccatgctatgtccatattctcctggccagcctctacgttgtcattcctcctatgctcaatcccgttatttatggagtgaggactaagccaatactggaaggggctaagcagatgttttcaaatcttgccaaaggatctaaataa

SEQ ID NO: 347 - protein, 428 aa, Homo sapiens
MFPSLCPCVLLVQLPLMNENMQCFVFCSCDSLLRMMVSRFIHVPFVKMKRIIVGGYSKHFFSNELLCVRPWSGKTWSIRHHIFDMELLTNNLKFITDPFVCRLRHLSPTPSEEHMKNKNNVTEFILLGLTQNPEGQKVLFVTFLLIYMVTIMGNLLIIVTIMASQSLGSPMYFFLASLSFIDTVYSTAFAPKMIVDLLSEKKTISFQGCMAQLFMDHLFAGAEVILLVVMAYDRYMAICKPLHELITMNRRVCVLMLLAAWIGGFLHSLVQFLFIYQLPFCGPNVIDNFLCDLYPLLKLACTNTYVTGLSMIANGGAICAVTFFTILLSYGVILHSLKTQSLEGKRKAFYTCASHVTVVILFFVPCIFLYARPNSTFPIDKSMTVVLTFITPMLNPLIYTLKNAEMKSAMRKLWSKKVSLAGKWLYHS

SEQ ID NO: 348 - DNA, 1287 bp, Homo sapiens
atgttcccctccctgtgtccatgtgttctccttgttcaactcccacttatgaatgagaacatgcagtgttttgttttctgttcttgtgatagtttgctgagaatgatggtttcccgcttcatccatgtcccatttgtaaaaatgaaaaggataattgtgggaggatattctaaacacttcttttctaatgagctgctctgtgtgaggccctggtcagggaaaacgtggtcgataaggcatcacatttttgacatggagcttctgacaaataatctcaaatttatcactgacccttttgtttgtaggctccgacacctgagtccaacaccttcagaagaacacatgaaaaataagaacaatgtgactgaatttatcctcttagggctcacacagaaccctgaggggcaaaaggttttatttgtcacattcttactaatctacatggtgacgataatgggcaacctgcttatcatagtgaccatcatggccagccagtccctgggttcccccatgtacttttttctggcttctttatcattcatagataccgtctattctactgcatttgctcccaaaatgattgttgacttgctctctgagaaaaagaccatttcctttcagggttgtatggctcaactttttatggatcatttatttgctggtgctgaagtcattcttctggtggtaatggcctatgatcgatacatggccatctgtaagcctcttcatgaattgatcaccatgaatcgtcgagtctgtgttcttatgctgttggcggcctggattggaggctttcttcactcattggttcaatttctctttatttatcagctccctttctgtggacccaatgtcattgacaacttcctgtgtgatttgtatcccttattgaaacttgcttgcaccaatacctatgtcactgggctttctatgatagctaatggaggagcgatttgtgctgtcaccttcttcactatcctgctttcctatggggtcatattacactctcttaagactcagagtttggaagggaaacgaaaagctttctacacctgtgcatcccacgtcactgtggtcattttattctttgtcccctgtatcttcttgtatgcaaggcccaattctacttttcccattgataaatccatgactgtagttctaacttttataactcccatgctgaacccactaatctataccctgaagaatgcagaaatgaaaagtgccatgaggaaactttggagtaaaaaagtaagcttagctgggaaatggctgtatcactcatga

SEQ ID NO: 349 - protein, 298 aa, Homo sapiens
MQQNNSVPEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGTPFLNPLIYTSEECRSEKCHEK

SEQ ID NO: 350 - DNA, 895 bp, Homo sapiens
atgcagcaaaataacagtgtgcctgaattcatactgttaggattaacacaggatcccttgaggcagaaaatagtgtttgtaatcttcttaattttctatatgggaactgtggtggggaatatgctcattattgtgaccatcaagtccagccggacactaggaagccccatgtacttctttctattttatttgtcctttgcagattcttgcttttcaacttccacagcccctagattaattgtggatgctctctctgaaaagaaaattataacctacaatgagtgcatgacacaagtctttgcactacatttatttggctgcatggagatctttgtcctcattctcatggctgttgatcgctatgtggccatctgtaagcccttgcgttacccaaccatcatgagccagcaggtctgcatcatcctgattgttcttgcctggatagggtctttaatacactctacagctcagattatcctggccttaagattgcctttctgtggaccctatttgattgatcattattgctgtgatttgcagcccttgttgaaacttgcctgcatggacacttacatgatcaacctgctgttggtgtctaacagtggggcaatttgctcaagtagtttcatgattttgataatttcatatattgtcatcttgcattcactgagaaaccacagtgccaaagggaagaaaaaggctctctccgcttgcacgtctcacataattgtagtcatcttattctttggcccatgtatattcatatatacacgccccccgaccactttccccatggacaagatggtggcagtattttatactattggaacaccctttctcaatccactcatctacacatctgaggaatgcagaagtgaaaaatgccatgagaaag

SEQ ID NO: 351 - protein, 306 aa, Homo sapiens [sequence omitted]

SEQ ID NO: 352 - DNA, 921 bp, Homo sapiens
atgcagaggagcaatcacacagtgactgagttcatcctgctgggcttcaccacagatccagggatgcaactgggcctctttgtggtgttcctgggtgtgtactgtctgactgtggtaggaagtagcaccctcatcgtgttgatctgtaatgactcccgcctacacacacccatgtattttgtcattggaaatctgtcatttctggatctctggtattcttctgtccacaccccaaagatcctagtgacctgcatctctgaagacaaaagcatctcctttgctggctgcctgtgtcagttcttctctgccaggctggcctatagtgagtgctacctactggctgccatggcttatgaccactacgtggccatctccaagcccctgctttatgctcagaccatgccaaggagattgtgcatctgtttggttttatattcctatactgggggttttgtcaatgcaataatattaaccagcaacacattcacattggatttttgtggtgacaatgtcattgatgactttttctgtgatgttccacccctcgtgaagctggcatgcagtgtgagagagagctaccaggctgtgctgcacttccttctggcctccaatgtcatctcccctactgtgctcatccttgcctcttacctctccatcatcaccaccatcctgaggatccactctacccagggccgcatcaaagtcttctccacatgctcctcccacctgatctccgttaccttatactatggctccattctctacaactactcccggccaagttccagctactccctcaagagggacaaaatggtttctaccttttatactatgctgttccccatgttgaatcccatgatctacagtctgaggagtaaagacatgaaagacgctctgaaaaaattcttcaagtcagcataa

SEQ ID NO: 353 - protein, 311 aa, Homo sapiens
MTGGGNITEITYFILLGFSDFPRIIKVLFTIFLVIYITSLAWNLSLIVLIRMDSHLHTPMYFFLSNLSFIDVCYISSTVPKMLSNLLQEQQTITFVGCIIQYFIFSTMGLSESCLMTAMAYDRYAAICNPLLYSSIMSPTLCVWMVLGAYMTGLTASLFQIGALLQLHFCGSNVIRHFFCDMPQLLILSCTDTFFVQVMTAILTMFFGIASALVIMISYGYIGISIMKITSAKGSPKAFNTCASHLTAVSLFYTSGIFVYLRSSSGGSSSFDRFASVFYTVVIPMLNPLIYSLRNKEIKDALKRLQKRKCC

SEQ ID NO: 354 - DNA, 936 bp, Homo sapiens
atgactgggggaggaaatattacagaaatcacctatttcatcctgctgggattctcagattttcccaggatcataaaagtgctcttcactatattcctggtgatctacattacatctctggcctggaacctctccctcattgttttaataaggatggattcccacctccatacacccatgtatttcttcctcagtaacctgtccttcatagatgtctgctatatcagctccacagtccccaagatgctctccaacctcttacaggaacagcaaactatcacttttgttggttgtattattcagtactttatcttttcaacgatgggactgagtgagtcttgtctcatgacagccatggcttatgatcgttatgctgccatttgtaaccccctgctctattcatccatcatgtcacccaccctctgtgtttggatggtactgggagcctacatgactggcctcactgcttctttattccaaattggtgctttgcttcaactccacttctgtgggtctaatgtcatcagacatttcttctgtgacatgccccaactgttaatcttgtcctgtactgacactttctttgtacaggtcatgactgctatattaaccatgttctttgggatagcaagtgccctagttatcatgatatcctatggctatattggcatctccatcatgaagatcacttcagctaaaggcagtccaaaggcattcaacacctgtgcttctcatctaacagctgtttccctcttctatacatcaggaatctttgtctatttgaggtccagctctggaggttcttcaagctttgacagatttgcatctgttttctacactgtggtcattcccatgttaaatcccttgatttacagtttgaggaacaaagaaattaaagatgccttaaagaggttgcaaaagagaaagtgctgctga

SEQ ID NO: 355 - protein, 314 aa, Homo sapiens
MENNTEVTEFILVGLTDDPELQIPLFIVFLFIYLITLVGNLGMIELILLDSCLHTPMYFFLSNLSLVDFGYSSAVTPKVMVGFLTGDKFILYNACATQFFFFVAFITAESFLLASMAYDRYAALCKPLHYTTTMTTNVCACLAIGSYICGFLNASIHTGNTFRLSFCRSNVVEHFFCDAPPLLTLSCSDNYISEMVIFFVVGFNDLFSILVILISYLFIFITIMKMRSPEGRQKAFSTCASHLTAVSIFYGTGIFMYLRPNSSHFMGTDKMASVFYAIVIPMLNPLVYSLRNKEVKSAFKKTVGKAKASIGFIF

SEQ ID NO: 356 - DNA, 945 bp, Homo sapiens
atggagaacaacacagaggtgactgaattcatccttgtggggttaactgatgacccagaactgcagatcccactcttcatagtcttccttttcatctacctcatcactctggttgggaacctggggatgattgaattgattctactggactcctgtctccacacccccatgtacttcttcctcagtaacctctccctggtggactttggttattcctcagctgtcactcccaaggtgatggtggggtttctcacaggagacaaattcatattatataatgcttgtgccacacaattcttcttctttgtagcctttatcactgcagaaagtttcctcctggcatcaatggcctatgaccgctatgcagcattgtgtaaacccctgcattacaccaccaccatgacaacaaatgtatgtgcttgcctggccataggctcctacatctgtggtttcctgaatgcatccattcatactgggaacactttcaggctctccttctgtagatccaatgtagttgaacactttttctgtgatgctcctcctctcttgactctctcatgttcagacaactacatcagtgagatggttattttttttgtggtgggattcaatgacctcttttctatcctggtaatcttgatctcctacttatttatatttatcaccatcatgaagatgcgctcacctgaaggacgccagaaggccttttctacttgtgcttcccaccttactgcagtttccatcttttatgggacaggaatctttatgtacttacgacctaactccagccatttcatgggcacagacaaaatggcatctgtgttctatgccatagtcattcccatgttgaatccactggtctacagcctgaggaacaaagaggttaagagtgcctttaaaaagactgtagggaaggcaaaggcctctataggattcatattttaa

SEQ ID NO: 357 - protein, 314 aa, Homo sapiens
MENKTEVTQFILLGLTNDSELQVPLFITFPFIYIITLVGNLGIIVLIFWDSCLHNPMYFFLSNLSLVDFCYSSAVTPIVMAGFLIEDKVISYNACAAQMYIFVAFATVENYLLASMAYDRYAAVCKPLHYTTTMTTTVCARLAIGSYLCGFLNASIHTGDTFSLSFCKSNEVHHFFCDIPAVMVLSCSDRHISELVLIYVVSFNIFIALLVILISYTFIFITILKMHSASVYQKPLSTCASHFIAVGIFYGTIIFMYLQPSSSHSMDTDKMAPVFYTMVIPMLNPLVYSLRNKEVKSAFKKVVEKAKLSVGWSV

SEQ ID NO: 358 - DNA, 945 bp, Homo sapiens
atggaaaataagacagaagtaacacaattcattcttctaggactaaccaatgactcagaactgcaggttcccctctttataacgttccccttcatctatattatcactctggttggaaacctgggaattattgtattgatattctgggattcctgtctccacaatcccatgtacttttttctcagtaacttgtctctagtggacttttgctactcttcagctgtcactcccatcgtcatggctggattccttatagaagacaaggtcatctcttacaatgcatgtgctgctcaaatgtatatctttgtagcttttgccactgtggaaaattacctcttggcctcaatggcctatgaccgctatgcagcagtgtgcaaacccctacattacaccacaaccatgacaacaactgtgtgtgctcgtctggccataggctcctacctctgtggtttcctgaatgcctccatccacactggggacacatttagtctctctttctgtaagtccaatgaagtccatcactttttctgtgatattccagcagtcatggttctctcttgctctgatagacatattagcgagcttgttcttatttatgttgtgagcttcaatatctttatagctctcctggttatcttgatatcctacacattcatttttatcaccatcctaaagatgcactcagcttcagtataccagaagcctttgtccacctgtgcctctcatttcattgcagtcggcatcttctatgggactattatcttcatgtacttacaacccagctccagtcactccatggacacagacaaaatggcacctgtgttctatacaatggtcatccccatgctgaaccctctggtctatagtctgaggaacaaggaagtgaagagtgcattcaagaaagttgttgagaaggcaaaattgtctgtaggatggtcagtttaa

SEQ ID NO: 359 - protein, 314 aa, Homo sapiens
MERQNQSCVVEFILLGFSNYPELQGQLFVAFLVIYLVTLIGNAIIIVIVSLDQSLHVPMYLFLLNLSVVDLSFSAVIMPEMLVVLSTEKTTISFGGCFAQMYFILLFGGAECFLLGAMAYDRFAAICHPLNYQMIMNKGVFMKLIIFSWALGFMLGTVQTSWVSSFPFCGLNEINHISCETPAVLELACADTFLFEIYAFTGTFLIILVPFLLILLSYIRVLFAILKMPSTTGRQKAFSTCAAHLTSVTLFYGTASMTYLQPKSGYSPETKKVMSLSYSLLTPLLNLLIYSLRNSEMKRALMKLWRRRVVLHTI

SEQ ID NO: 360 - DNA, 945 bp, Homo sapiens
atggaaagacaaaatcaaagctgtgtggttgaattcatcctcttgggcttttctaactatcctgagctccaggggcagctctttgtggctttcctggttatttatctggtgaccctgataggaaatgccattattatagtcatcgtctccctagaccagagcctccacgttcccatgtacctgtttctcctgaacttatctgtggtggacctgagtttcagtgcagttattatgcctgaaatgctggtggtcctctctactgaaaaaactacaatttcttttgggggctgttttgcacagatgtatttcatccttctttttggtggggctgaatgttttcttctgggagcaatggcttatgaccgatttgctgcaatttgccatcctctcaactaccaaatgattatgaataaaggagtttttatgaaattaattatattttcatgggccttaggttttatgttaggtactgttcaaacatcatgggtatctagttttcccttttgtggccttaatgaaattaaccatatatcttgtgaaaccccagcagtgttagaacttgcatgtgcagacacgtttttgtttgaaatctatgcattcacaggcacctttttgattattttggttcctttcttgttgatactcttgtcttacattcgagttctgtttgccatcctgaagatgccatcaaccactgggagacaaaaggccttttccacctgtgccgctcacctcacatctgtgaccctattctatggcacagccagtatgacttatttacaacccaaatctggctactcaccggaaaccaagaaagtgatgtcattgtcttactcacttctgacaccactgctgaatctgcttatctacagtttgcgaaatagtgagatgaagagggctttgatgaaattatggcgaaggcgagtggttttacacacaatctga

SEQ ID NO: 361 - protein, 347 aa, Homo sapiens
MIVQLICTVCFLAVNTFHVRSSFDFLKADDMGEINQTLVSEFLLLGLSGYPKIEIVYFALILVMYLVILIGNGVLIIASIFDSHFHTPMYFFLGNLSFLDICYTSSSVPSTLVSLISKKRNISFSGCAVQMFFGFAMGSTECLLLGMMAFDRYVAICNPLRYPIILSKVAYVLMASVSWLSGGINSAVQTLLAMRLPFCGNNIINHFACEILAVLKLACADISLNIITMVISNMAFLVLPLMVIFFSYMFILYTILQMNSATGRRKAFSTCSAHLTVVIIFYGTIFFMYAKPKSQDLIGEEKLQALDKLISLFYGVVTPMLNPILYSLRNKDVKAAVKYLLNKKPIH

SEQ ID NO: 362 - DNA, 1044 bp, Homo sapiens
atgattgttcagttaatttgtactgtttgtttcttggcagtaaatacatttcatgttagatcttcttttgatttcctgaaagcagatgacatgggtgagattaaccagacacttgtgtcagaatttcttcttctgggtctttctggatacccaaagattgagattgtttactttgctctcattctagttatgtacctagtgattctaattggcaatggtgttctaatcatagccagcatctttgattctcattttcacacaccaatgtacttcttcctgggcaacctctctttcctggatatctgctatacatcctcctctgttccctcaacattggtgagcttaatctcaaagaaaagaaacatttccttctctggatgtgcagtgcagatgttctttgggtttgcaatggggtcaacagaatgtctgcttcttggcatgatggcatttgatcgttatgtggccatctgcaacccactgagataccccatcatcctgagcaaggtggcgtatgtattgatggcttctgtgtcctggctgtccggtggaataaattcagctgtgcaaacattacttgccatgagactgcctttctgtgggaataatattatcaatcatttcgcatgtgaaatattagctgtcctcaagctggcctgtgctgatatatccctcaatattatcaccatggtgatatcaaatatggccttcctggttcttccactgatggtcatttttttctcctatatgttcatcctctacaccatcttgcaaatgaattcagccacaggaagacgcaaggcattttccacgtgctcagctcacctgactgtggtgatcatattttacggtaccatcttctttatgtatgcgaaaccgaagtctcaagacctgattggggaagaaaaattgcaagcattagacaagctcatttctctgttttatggggtagtgacacccatgctgaatcctatactctatagcttgagaaataaggatgtaaaagctgctgtaaaatatttgctgaacaaaaaaccaattcactaa

SEQ ID NO: 363 - protein, 324 aa, Homo sapiens
MLESNYTMPTEFLFVGFTDYLPLRVTLFLVFLLVYTLTMVGNILLIILVNINSSLQIPMYYFLSNLSFLDISCSTAITPKMLANFLASRKSISPYGCALQMFFFASFADAECLILAAMAYDRYAAICNPLLYTTLMSRRVCVCFIVLAYFSGSTTSLVHVCLTFRLSFCGSNIVNHFFCDIPPLLALSCTDTQINQLLLFALCSFIQTSTFVVIFISYFCILITVLSIKSSGGRSKTFSTCASHLIAVTLFYGALLFMYLQPTTSYSLDTDKVVAVFYTVVFPMFNPIIYSFRNKDVKNALKKLLERIGYSNEWYLNRLRIVNI

SEQ ID NO: 364 - DNA, 975 bp, Homo sapiens
atgttggagagtaattacaccatgccaactgagttcctatttgttggattcacagattatctacctctcagagtcacactgttcttggtattccttctggtatatacattaactatggtcggaaatatactcttaataattctagttaatattaattcaagccttcaaattcccatgtattattttcttagcaacttatctttcttagacatcagctgttctacagcaatcactcctaaaatgctggcaaacttcttggcatccaggaaaagcatctctccttatgggtgtgcactacaaatgtttttcttcgcttcttttgctgatgctgagtgccttatcctggcagcaatggcttatgaccgctatgcagccatctgcaacccactgctctaatactacactgatgtctaggagagtctgtgtctgcttcattgtgttggcatatttcagtggaagtacaacatcactggtccatgtgtgcctcacattcaggctgtcattttgtggctccaatatcgtcaatcattttttctgtgatatcccacctcttctggctttatcatgtacagacactcagatcaaccagcttctgctctttgctttgtgcagcttcatccagaccagcacttttgtggtaatatttatttcttacttctgcatcctcatcactgtgttgagcatcaagtcctcaggtggcagaagcaaaacattctccacttgtgcttcccacctcatagcagtcaccttattctatggagcgctcctgtttatgtacttacagcccaccactagctattccctagacactgataaggtggtggcagtgttttatactgttgtatttcccatgtttaatccaataatttatagtttcagaaacaaggatgtgaaaaatgctctcaaaaagctattagaaagaattggatattcaaatgaatggtatttaaatcgtttaagaatagtcaatatcta

SEQ ID NO: 365 - protein, 334 aa, Homo sapiens
MCYLSQLCLSLGEHTLHMGMVRHTNESNLAGFILLGFSDYPQLQKVLFVLILILYLLTILGNTTIILVSRLEPKLHMPMYFFLSHLSFLYRCFTSSVIPQLLVNLWEPMKTIAYGGCLVHLYNSHALGSTECVLLALMSCDRYVAVCRPLHYTVLMHIHLCMALASMAWLSGIATTLVQSTLTLQLPFCGHRQVDHFICEVPVLIKLACVGTTFNEAELFVASILFLIVPVSFILVSSGYIAHAVLRIKSATRRQKAFGTCFSHLTVVTIFYGTIIFMYLQPAKSRSRDQGKFVSLFYTVVTRMLNPLIYTLRIKEVKGALKKVLAKALGVNIL

SEQ ID NO: 366 - DNA, 1005 bp, Homo sapiens
atgtgttatctttctcagctatgcctcagccttggggaacacactttacatatggggatggtgagacataccaatgagagcaacctagcaggtttcatccttttagggttttctgattatcctcagttacagaaggttctatttgtgctcatattgattctgtatttactaactattttggggaataccaccatcattctggtttctcgtctggaacccaagcttcatatgccgatgtatttcttcctttctcatctctccttcctgtaccgctgcttcaccagcagtgttattccccagctcctggtaaacctgtgggaacccatgaaaactatcgcctatggtggctgtttggttcacctttacaactcccatgccctgggatccactgagtgcgtcctcttggctctgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcatttcatctgcgaggtccctgtgctcatcaagctggcttgtgtgggcaccacgtttaacgaggctgagctttttgtggctagtatccttttccttatagtgcctgtctcattcatcctggtctcctctggctacattgcccacgcagtgttgaggattaagtcagctaccaggagacagaaagcattcgggacctgcttctcccacctgacagtggtcaccatcttttatggaaccatcatcttcatgtatctgcagccagccaagagtagatccagggaccagggcaagtttgtttctctcttctacactgtggtaacccgcatgcttaaccctcttatttataccttgaggatcaaggaggtgaaaggggcattaaagaaagttctagcaaaggctctgggagtaaatattttatga

SEQ ID NO: 367 - protein, 309 aa, Homo sapiens
MENCTEVTKFILLGLTSVPELQIPLFILFTFIYLLTLCGNLGMMLLILMDSCLHTPMYFFLSNLSLVDFGYSSAVTPKVMAGFLRGDKVISYNACAVQMFFFVALATVENYLLASMAYDRYAAVCKPLHYTTTMTASVGACLALGSYVCGFLNASFHIGGIFSLSFCKSNLVHHFFCDVPAVMALSCSDKHTSEVILVFMSSFNIFFVLLVIFISYLFIFITILKMHSAKGHQKALSTCASHFTAVSVFYGTVIFIYLQPSSSHSMDTDKMASVFYAMIIPMLNPVVYSLRNREVQNAFKKVLRRQKFL

SEQ ID NO: 368 - DNA, 930 bp, Homo sapiens
atggagaattgtacggaagtgacaaagttcattcttctaggactaaccagtgtcccagaactacagatccccctctttatcttgttcaccttcatctacctcctcactctgtgtgggaacctggggatgatgttgctgatcctgatggactcttgtctccacacccccatgtactttttcctcagtaacctgtctctggtggactttggatactcctcagctgtcactcccaaggtcatggctgggttccttagaggagacaaggtcatctcctacaatgcatgtgctgttcagatgttcttctttgtagccttggccacggtggaaaattacttgttggcctcaatggcctatgaccgctatgcagcagtgtgcaaacccctacactacaccaccaccatgacggccagtgtaggtgcctgtctggccctaggctcatatgtctgtggcttcctaaatgcctcattccacattgggggcatattcagtctctctttctgtaaatccaatctggtacatcactttttctgtgatgttccagcagtcatggctctgtcttgctctgataaacacactagtgaggtgattctggtttttatgtcaagctttaatatcttttttgttcttctagttatctttatctcctacttgttcatattcatcaccatcttgaagatgcattcagctaagggacaccaaaaagcattgtccacctgtgcctctcacttcactgcagtctccgtcttctatgggacagtaatcttcatctacttgcagcccagctccagccactccatggacacagacaaaatggcatctgtgttctatgctatgatcatccccatgctgaaccctgtggtctacagcctgaggaacagagaagtccagaatgcattcaagaaagtgttgagaaggcaaaaatttctataa

SEQ ID NO: 369 - protein, 308 aa, Homo sapiens
MDTGNKTLPQDFLLLGFPGSQTLQLSLFMLFLVMYILTVSGNVAILMLVSTSHQLHTPMYFFLSNLSFLEIWYTTAAVPKALAILLGRSQTISFTSCLLQMYFVFSLGCTEYFLLAAMAYDRCLAICYPLHYGAIMSSLLSAQLALGSWVCGFVAIAVPTALISGLSFCGPRAINHFFCDIAPWIALACTNTQAVELVAFVIAVVVILSSCLITFVSYVYIISTILRIPSASGRSKAFSTCSSHLTVVLIWYGSTVFLHVRTSIKDALDLIKAVHVLNTVVTPVLNPFIYTLRNKEVRETLLKKWKGK

SEQ ID NO: 370 - DNA, 927 bp, Homo sapiens
atggacacaggcaacaaaactctgccccaggactttctcttactgggctttcctggttctcaaactcttcagctctctctctttatgctttttctggtgatgtacatcctcacagttagtggtaatgtggctatcttgatgttggtgagcacctcccatcagttgcatacccccatgtacttctttctgagcaacctctccttcctggagatttggtataccacagcagcagtgcccaaagcactggccatcctactggggagaagtcagaccatatcatttacaagctgtcttttgcagatgtactttgttttctcattaggctgcacagagtacttcctcctggcagccatggcttatgaccgctgtcttgccatctgctatcctttacactacggagccatcatgagtagcctgctctcagcgcagctggccctgggctcctgggtgtgtggtttcgtggccattgcagtgcccacagccctcatcagtggcctgtccttctgtggcccccgtgccatcaaccacttcttctgtgacattgcaccctggattgccctggcctgcaccaacacacaggcagtagagcttgtggcctttgtgattgctgttgtggttatcctgagttcatgcctcatcacctttgtctcctatgtgtacatcatcagcaccatcctcaggatcccctctgccagtggccggagcaaagccttctccacgtgctcctcgcatctcaccgtggtgctcatttggtatgggtccacagttttccttcacgtccgcacctctatcaaagatgccttggatctgatcaaagctgtccacgtcctgaacactgtggtgactccagttttaaaccccttcatctatacgcttcgtaataaggaagtaagagagactctgctgaagaaatggaagggaaaataa

SEQ ID NO: 371 - protein, 314 aa, Homo sapiens
MTRKNYTSLTEFVLLGLADTLELQIILFLFFLVIYTLTVLGNLGMILLIRIDSQLHTPMYFFLANLSFVDVCNSTTITPKMLADLLSEKKTISFAGCFLQMYFFISLATTECILFGLMAYDRYAAICRPLLYSLIMSRTVYLKMAAGAFAAGLLNFMVNTSHVSSLSFCDSNVIHHFFCDSPPLFKLSCSDTILKESISSILAGVNIVGTLLVILSSYSYVLFSIFSMHSGEGRHRAFSTCASHLTAIILFYATCIYTYLRPSSSYSLNQDKVASVFYTVVIPMLNPLIYSLRSKEVKKALANVISRKRTSSFL

SEQ ID NO: 372 - DNA, 945 bp, Homo sapiens
atgaccagaaaaaattatacctcactgactgagttcgtcctattgggattagcagacacgctggagctacagattatcctctttttgttttttcttgtgatttatacacttacagtactgggaaatctcgggatgatcctcttaatcaggatcgattcccagcttcacacacccatgtatttcttcctggctaacctgtcctttgtggacgtttgtaactcaactaccatcaccccaaagatgctggcagatttattatcagagaagaaaaccatctcttttgctggctgcttcctacagatgtacttctttatctccctggcgacaaccgaatgcatcctctttgggttaatggcctatgacaggtatgcggccatatgtcgcccgctgctttactccttgatcatgtccaggaccgtctacctaaaaatggcagccggggcttttgctgcagggttgctgaacttcatggtcaacacaagccatgtcagcagcttgtcattctgtgactccaatgtcatccatcacttcttctgtgacagtcccccacttttcaagctctcttgttctgacacaatcctgaaagaaagcataagttctattttggctggtgtgaatattgtggggactctgcttgtcatcctctcctcctactcctacgttctcttctccattttttctatgcattcgggggaggggaggcacagagctttctccacgtgtgcctctcacctgacagccataattctgttctatgccacctgcatctatacttacctgagacctagttccagctactccctgaatcaggacaaagtggcttctgtgttctacacagtggtgattcccatgttgaatcctctgatctacagcctcaggagtaaggaagtaaagaaggctttagcgaatgtaattagcaggaaaaggacctcttcctttctgtga

SEQ ID NO: 373 - protein, 318 aa, Homo sapiens
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLGLAMGTTECVLLGMMAFDRYVAICNPLRYPIIMSKDAYVPMAAGSWIIGAVNSAVQSVFVVQLPFCRNNIINHFTCEILAVMKLACADISDNEFIMLVATTLFILTPLLLIIVSYTLIIVSIFKISSSEGRSKASSTCSAHLTVVIIFYGTILFMYMKPKSKETLNSDDLDATDKIISMFYGVMTPMMNPLIYSLRNKDVKEAVKHLLNRRFFSK

SEQ ID NO: 374 - DNA, 957 bp, Homo sapiens
atggaatgggaaaaccacaccattctggtggaattttttctgaagggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcggcttggccatggggacaacagagtgtgtgcttctgggcatgatggcctttgaccgctatgtggctatctgcaaccctctgagatatcccatcatcatgagtaaggatgcctatgtacccatggcagctgggtcctggatcataggagctgtcaattctgcagtacaatcagtgtttgtggtacaattgcctttctgcaggaataacatcatcaatcatttcacctgtgaaattctggctgtcatgaaactggcctgtgctgacatctcagacaatgagttcatcatgcttgtggccacaacattgttcatattgacacctttgttattaatcattgtctcttacacgttaatcattgtgagcatcttcaaaattagctcttccgaggggagaagcaaagcttcctctacctgttcagcccatctgactgtggtcataatattctatgggaccatcctcttcatgtacatgaagcccaagtctaaagagacacttaattcggatgacttggatgctaccgacaaaattatatccatgttctatggggtgatgactcccatgatgaatcctttaatctacagtcttagaaacaaggatgtgaaagaggcagtaaaacacctactgaacagaaggttctttagcaagtga

SEQ ID NO: 375 - protein, 318 aa, Homo sapiens
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLSLAMGTTECVLLGVMAFDRYVAICNPLRYPIIMSKDAYVPMAAGSWIIGAVNSAVQTVFVVQLPFCRNNIINHFTCEILAVMKLACADISGNEFILLVTTTLFLLTPLLLIIVSYTLIILSIFKISSSEGRSKPSSTCSARLTVVITFCGTIFLMYMKPKSQETLNSDDLDATDKLIFIFYRVMTPMMNPLIYSLRNKDVKEAVKHLLRRKNFNK

SEQ ID NO: 376 - DNA, 957 bp, Homo sapiens
atggaatgggaaaaccacaccattctggtggaattttttctgaagggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcagcttggccatggggacaacagagtgtgtgcttctgggcgtgatggcctttgaccgctatgtggctatctgcaaccctctgagatatcccatcatcatgagtaaggatgcctatgtacccatggcagctgggtcctggatcataggagctgtcaattctgcagtacaaacagtgtttgtggtacaattgcctttctgcaggaataacatcatcaatcatttcacctgtgaaattctagctgtcatgaaactggcctgtgctgacatctcaggcaatgagttcatcctgcttgtgaccacaacattgttcctattgacacctttgttattaattattgtctcttacacgttaatcattttgagcatcttcaaaattagctcttcggaggggagaagcaaaccttcctctacctgctcagctcgtctgactgtggtgataacattctgtgggaccatcttcctcatgtacatgaagcccaagtctcaagagacacttaattcagatgacttggatgccactgacaaacttatattcatattctacagggtgatgactcccatgatgaatcctttaatctacagtcttagaaacaaggatgtgaaggaggcagtaaaacacctactgagaagaaaaaattttaacaagtaa

SEQ ID NO: 377 - protein, 314 aa, Homo sapiens
MKRQNQSCVVEFILLGFSNFPELQVQLFGVFLVIYVVTLMGNAIITVIISLNQSLHVPMYLFLLNLSVVEVSFSAVITPEMLVVLSTEKTMISFVGCFAQMYFILLFGGTECFLLGAMAYDRFAAICHPLNYPVIMNRGVFMKLVIFSWISGIMVATVQTTWVFSFPFCGPNEINHLFCETPPVLELVCADTFLFEIYAFTGTILIVMVPFLLILLSYIRVLFAILKMPSTTGRQKAFSTCASHLTSVTLFYGTANMTYLQPKSGYSPETKKLISLAYTLLTPLLNPLIYSLRNSEMKRTLIKLWRRKVILHTF

SEQ ID NO: 378 - DNA, 945 bp, Homo sapiens
atgaaaagacaaaatcaaagctgtgtggttgaattcatcctcctgggcttttctaactttcctgagctccaggtgcagctctttggggttttcctagttatttatgtggtgaccctgatgggaaatgccatcattacagtcatcatctccttaaaccagagcctccacgttcccatgtacctgttcctcctgaacctatctgtggtggaggtgagtttcagtgcagtcattacgcctgaaatgctggtggtgctctctactgagaaaactatgatttcttttgtgggctgttttgcacagatgtatttcatccttctttttggtgggactgaatgttttctcctgggagcgatggcttatgaccgatttgctgcaatttgccatcctctgaactacccagtgattatgaacagaggggtttttatgaaattagtaatattctcatggatctcagggatcatggtggctactgtgcagaccacttgggtatttagttttccattttgtggccccaatgaaattaatcatctcttctgtgagactcccccggtactagagcttgtgtgtgcagacaccttcttatttgaaatctatgccttcacaggcaccattttgattgttatggttcctttcttgttgatcctcttgtcttacattcgagttctgtttgccatcctgaagatgccatcaactactgggagacaaaaggccttttccacctgtgcctctcacctcacatctgtgaccctgttctatggcacagccaatatgacttatttacaacccaaatctggctactcacccgaaaccaagaaactgatctcattggcttacacgttgcttacccctctgctcaatccgctcatctatagcttacgaaacagtgagatgaagaggactttgataaaactatggcgaagaaaagtgattttacacacattctga

SEQ ID NO: 379 - protein, 309 aa, Homo sapiens
MEKKKNVTEFILIGLTQNPIMEKVTFVVFLVLYMITLSGNLLIVVTITTSQALSSPMYFFLTHLSLIDTVYSSSSAPKLIVDSFQEKKIISFNGCMAQAYAEHIFGATEIILLTVMACDCYVAICKPLNYTTIMSHSLCILLVAVAWVGGFLHATIQILFTVWLPFCGPNVIGHFMCDLYPLLKLVCIDTHTLGLFVAVNSGFICLLNFLILVVSYVIILRSLKNNSLEGRCKALSTCISHIIVVVLFFVPCIFVYLRSVTTLPIDKAVAVFYTMVVPMLNPVVYTLRNAEVKSAIRKLWRKKVTSDND

SEQ ID NO: 380 - DNA, 930 bp, Homo sapiens
atggagaagaaaaagaatgtgactgaattcattttaataggtcttacacagaaccccataatggagaaagtcacgtttgtagtatttttggttctttacatgataacactttcaggcaacctgctcattgtggttaccattaccaccagccaggctctgagctcccccatgtacttcttcctgacccacctttctttgatagacacagtttattcttcttcttcagctcctaagttgattgtggattcctttcaagagaagaaaatcatctcctttaatgggtgtatggctcaagcctatgcagaacacatttttggtgctactgagatcatcctgctgacagtgatggcctgtgactgctatgtggccatctgcaaacctctgaactacacaaccattatgagccacagcctgtgcattctcctggtggcagtggcctgggtgggaggatttcttcatgcaactattcagattctctttacagtatggctgcccttctgtggccccaatgtcataggccacttcatgtgtgacttgtacccattgttaaaacttgtttgcatagacactcatacccttggtctctttgttgctgtgaacagtgggtttatctgcttattaaacttccttatcttggtggtatcctatgtgatcatcttgagatctttaaagaacaatagcttggaggggaggtgtaaagccctctccacctgtatttctcacatcatagtagttgtcttattctttgtgccctgtatatttgtgtatctgcgctcagtgaccactctgcccattgataaagctgttgctgtattttatactatggtggtcccaatgttaaatcccgtggtctacacactcagaaatgctgaggtaaaaagtgcaataaggaagctttggagaaaaaaagtgacttcagataatgattaa

SEQ ID NO: 381 - protein, 307 aa, Homo sapiens [sequence omitted]

SEQ ID NO: 382 - DNA, 924 bp, Homo sapiens
atggaaagcgagaacagaacagtgataagagaattcatcctccttggtctgacccagtctcaagatattcagctcctggtctttgtgctagttttaatattctacttcatcatcctccctggaaattttctcattattttcaccataaagtcagaccctgggctcacagcccccctctatttctttctgggcaacttggccttcctggatgcatcctactccttcactgtggctccccggatgttggtggacttcctctctgcgaagaagataatctcctacagaggctgcatcactcagctctttttcttgcacttccttggaggaggggagggattactccttgttgtgatggcctttgaccgctacatcgccatctgccggcctctgcactatcctactgtcatgaaccctagaacctgctatgcaatgatgttggctctgtggcttgggggttttgtccactccattatccaggtggtcctcatcctccgcttgcctttttgtggcccaaaccagctggacaacttcttctgtgatgtcccacaggtcatcaagctggcctgcaccgacacatttgtggtggagcttctgatggtcttcaacagtggcctgatgacactcctgtgctttctggggcttctggcctcctatgcagtcattctttgtcgcatacgagggtcttcttctgaggcaaaaaacaaggccatgtccacgtgcatcacccatatcattgttatattcttcatgtttggacctggcatcttcatctacacgcgccccttcagggctttcccagctgacaaggtggtttctctcttccacacagtgatttttcctttgttgaatcctgtcatttatacccttcgcaaccaggaagtgaaagcttccatgaaaaaggtgtttaataagcacatagcctga

SEQ ID NO: 383 - protein, 309 aa, Homo sapiens
MANRNNVTEFILLGLTENPKMQKIIFVVFSVIYINAMIGNVLIVVTITASPSLRSPMYFFLAYLSFIDACYSSVNTPKLITDSLYENKTILFNGCMTQVFGEHFFRGVEVILLTVMAYDHYVAICKPLHYTTIMKQHVCSLLVGVSWVGGFLHATIQILFICQLPFCGPNVIDHFMCDLYTLINLACTNTHTLGLFIAANSGFICLLNCLLLLVSCVVILYSLKTHSLEARHEALSTCVSHITVVILSFIPCIFVYMRPPATLPIDKAVAVFYTMITSMLNPLIYTLRNAQMKNAIRKLCSRKAISSVK

SEQ ID NO: 384 - DNA, 930 bp, Homo sapiens
atggcgaatagaaacaatgtgacagagtttattctattggggcttacagagaatccaaaaatgcagaaaatcatatttgttgtgttttctgtcatctacatcaacgccatgataggaaatgtgctcattgtggtcaccatcactgccagcccatcactgagatcccccatgtactttttcctggcctatctctcctttattgatgcctgctattcctctgtcaatacccctaagctgatcacagattcactctatgaaaacaagactatcttattcaatggatgtatgactcaagtctttggagaacattttttcagaggtgttgaggtcatcctacttactgtaatggcctatgaccactatgtggccatctgcaagcccttgcactataccaccatcatgaagcagcatgtttgtagcctgctagtgggagtgtcatgggtaggaggctttcttcatgcaaccatacagatcctcttcatctgtcaattacctttctgtggtcctaatgtcatagatcactttatgtgtgatctctacactttgatcaatcttgcctgcactaatacccacactctaggactcttcattgctgccaacagtgggttcatatgcctgttaaactgtctcttgctcctggtctcctgcgtggtcatactgtactccttaaagacccacagcttagaggcaaggcatgaagccctctctacctgtgtctcccacatcacagttgtcatcttatcctttataccctgcatatttgtgtacatgagacctccagctactttacccattgataaagcagttgctgtattctacactatgataacttctatgttaaaccccttaatctacaccttgaggaatgctcaaatgaaaaatgccattaggaaattgtgtagtaggaaagctatttcaagtgtcaaataa

SEQ ID NO: 385 - protein, 320 aa, Homo sapiens
MERTNDSTSTEFFLVGLSAHPKLQTVFFVLILWMYLMILLGNGVLISVIIFDSHLHTPMYFFLCNLSFLDVCYTSSSVPLILASFLAVKKKVSFSGCMVQMFISFAMGATECMILGTMALDRYVAICYPLRYPVIMSKGAYVAMAAGSWVTGLVDSVVQTAFAMQLPFCANNVIKHFVCEILAILKLACADISINVISMTGSNLIVLVIPLLVISISYIFIVATILRIPSTEGKHKAFSTCSAHLTVVIIFYGTIFFMYAKPESKASVDSGNEDIIEALISLFYGVMTPMLNPLIYSLRNKDVKAAVKNILCRKNFSDGK

SEQ ID NO: 386 - DNA, 963 bp, Homo sapiens
atggaaaggaccaacgattccacgtcgacagaatttttcctggtagggctttctgcccacccaaagctccagacagttttcttcgttctaattttgtggatgtacctgatgatcctgcttggaaatggagtccttatctcagttatcatctttgattctcacctgcacacccccatgtatttcttcctctgtaatctttccttcctcgacgtttgctacacaagttcctctgtcccactaattcttgccagctttctggcagtaaagaaaaaggtttccttctctgggtgtatggtgcaaatgtttatttcttttgccatgggggccacggagtgcatgatcttaggcacgatggcactggaccgctatgtggccatctgctacccactgagataccctgtcatcatgagcaagggtgcctatgtggccatggcagctgggtcctgggtcactgggcttgtggactcagtagtgcagacagcttttgcaatgcagttaccattctgtgctaataatgtcattaaacattttgtctgtgaaattctggctatcttgaaactggcctgtgctgatatttcaatcaatgtgattagtatgacagggtcgaatctgattgttctggttattccattgttagtaatttccatctcttacatatttattgttgccactattctgaggattccttccactgaaggaaaacataaggccttctccacctgctcagcccacctgacagtggtgattatattctatggaaccatcttcttcatgtacgcaaagcctgagtctaaagcctctgttgattcaggtaatgaagacatcattgaggccctcatctcccttttctatggagtgatgactcccatgcttaatcctctcatctatagtctgcgaaacaaggatgtaaaggctgctgtcaaaaacatactgtgtaggaaaaacttttctgatggaaaatga

SEQ ID NO: 387 - protein, 319 aa, Homo sapiens
MFPANWTSVKVFFFLGFFHYPKVQVIIFAVCLLMYLITLLGNIFLISITILDSHLHTPMYLFLSNLSFLDIWYSSSALSPMLANFVSGRNTISFSGCATQMYLSLAMGSTECVLLPMMAYDRYVAICNPLRYPVIMNRRTCVQIAAGSWMTGCLTAMVEMMSVLPLSLCGNSIINHFTCEILAILKLVCVDTSLVQLIMLVISVLLLPMPMLLICISYAFILASILRISSVEGRSKAFSTCTAHLMVVVLFYGTALSMHLKPSAVDSQEIDKFMALVYAGQTPMLNPIIYSLRNKEVKVALKKLLIRNHFNTAFISILK

SEQ ID NO: 388 - DNA, 960 bp, Homo sapiens
atgttcccggcaaattggacatctgtaaaagtatttttcttcctgggattttttcactaccccaaagttcaggtcatcatatttgcggtgtgcttgctgatgtacctgatcaccttgctgggcaacatttttctgatctccatcaccattctagattcccacctgcacacccctatgtacctcttcctcagcaatctctcctttctggacatctggtactcctcttctgccctctctccaatgctggcaaactttgtttcagggagaaacactatttcattctcagggtgcgccactcagatgtacctctcccttgccatgggctccactgagtgtgtgctcctgcccatgatggcatatgaccggtatgtggccatctgcaaccccctgagataccctgtcatcatgaataggagaacctgtgtgcagattgcagctggctcctggatgacaggctgtctcactgccatggtggaaatgatgtctgtgctgccactgtctctctgtggtaatagcatcatcaatcatttcacttgtgaaattctggccatcttgaaattggtttgtgtggacacctccctggtgcagttaatcatgctggtgatcagtgtacttcttctccccatgccaatgctactcatttgtatctcttatgcatttatcctcgccagtatcctgagaatcagctcagtggaaggtcgaagtaaagccttttcaacgtgcacagcccacctgatggtggtagttttgttctatgggacggctctctccatgcacctgaagccctccgctgtagattcacaggaaatagacaaatttatggctttggtgtatgccggacaaacccccatgttgaatcctatcatctatagtctacggaacaaagaggtgaaagtggccttgaaaaaattgctgattagaaatcattttaatactgccttcatttccatcctcaaataa

SEQ ID NO: 389 - protein, 318 aa, Homo sapiens
MDKINQTFVREFILLGLSGYPKLEIIFFALILVMYVVILIGNGVLIIASILDSRLHMPMYFFLGNLSFLDICYTTSSIPSTLVSLISKKRNISFSGCAVQMFFGFAMGSTECFLLGMMAFDRYVAICNPLRYPIIMNKVVYVLLTSVSWLSGGINSTVQTSLAMRWPFCGNNIINHFLCEILAVLKLACSDISVNIVTLAVSNIAFLVLPLLVIFFSYMFILYTILRTNSATGRHKAFSTCSAHLTVVIIFYGTIFFMYAKPKSQDLLGKDNLQATEGLVSMFYGVVTPMLNPIIYSLRNKDVKAAIKYLLSRKAINQ

SEQ ID NO: 390 - DNA, 957 bp, Homo sapiens
atggacaagataaaccagacatttgtgagagaattcattcttctgggactctctggttaccccaaacttgagatcattttctttgctctgattctagttatgtacgtagtgattctaattggcaatggtgttctgatcatagcaagcatcttggattctcgtcttcacatgcccatgtacttcttcctgggcaacctctctttcctggatatctgctatacaacctcctccattccctcaacactggtgagcttaatctcaaagaaaagaaacatttccttctctggatgtgcagtgcagatgttctttgggtttgcaatggggtcaacagaatgtttcctccttggcatgatggcatttgatcgttatgtggccatctgtaaccctctgagataccccatcatcatgaacaaggtggtgtatgtactgctgacttctgtatcatggctttctggtggaatcaattcaactgtgcaaacatcacttgccatgcgatggcctttctgtgggaacaatattattaatcatttcttatgcgagatcttagctgtcctaaaattagcttgttctgatatatctgtcaatattgttaccctagcagtgtcaaatattgctttcctagttcttcctctgctcgtgatttttttctcctatatgttcatcctctacaccatcttgcgaacgaactcggccacaggaagacacaaggcattttctacatgctcagctcacctgactgtggtgatcatattttatggtaccatcttctttatgtatgcaaaacctaagtcccaggacctccttgggaaagacaacttgcaagctacagaggggcttgtttccatgttttatggggttgtgacccccatgttaaaccccataatctatagcttgagaaataaagatgtaaaagctgctataaaatatttgctgagcaggaaagctattaaccagtaa

SEQ ID NO: 391 - protein, 312 aa, Homo sapiens
MMGRRNDTNVADFILTGLSDSEEVQMALFMLFLLIYLITMLGNVGMLLIIRLDLQLHTPMYFFLTHLSFIDLSYSTVVTPKTLANLLTSNYISFTGCFAQMFCFVFLGTAECYLLSSMAYDRYAAICSPLHYTVIMPKRLCLALITGPYVIGFMDSFVNVVSMSRLHFCDSNIIHHFFCDTSPILALSCTDTDNTEMLIFIIAGSTLMVSLITISASYVSILSTILKINSTSGKQKAFSTCVSHLLGVTIFYGTMIFTYLKPRKSYSLGRDQVAPVFYTIVIPMLNPLIYSLRNREVKNALIRVMQRRQDSR

SEQ ID NO: 392 - DNA, 939 bp, Homo sapiens
atgatgggtagaaggaatgacacaaatgtggctgacttcatccttacgggactgtcagactctgaagaggtccagatggctctgtttatgctatttctcctcatatacctaattactatgctggggaatgtggggatgctattgataatccgcctggacctccagcttcacactcccatgtattttttccttactcacctgtcatttattgacctcagttactcaactgtcgtcacacctaaaaccttagcgaacttactgacttccaactatatttccttcacgggctgctttgcccagatgttctgttttgtcttcttgggtactgctgaatgttatcttctctcctcaatggcctatgatcgctatgcagcgatctgcagtcctctacactacacagttattatgcccaaaaggctctgcctcgctctcatcactgggccttatgtgattggctttatggactcctttgtcaatgtggtttccatgagcagattgcatttctgtgactcaaacataattcatcactttttctgtgacacttccccaattttagctctgtcctgcactgacacagacaacactgaaatgctgatattcattatcgctggttccaccctgatggtgtcccttatcacaatatctgcatcctatgtgtccattctctctaccatcctgaaaattaattccacttcaggaaagcagaaagctttctctacttgcgtctctcatctcttgggagtcaccatcttctatggaactatgatttttacttacttaaagccaagaaagtcttattccttgggaagagatcaagtggctcctgtgttttatactattgtgattcccatgctgaatccactcatttatagtcttagaaacagagaagtgaaaaatgctctcattagagtcatgcagagaagacaggactccaggtag

SEQ ID NO: 393 - protein, 312 aa, Homo sapiens
MMGRRNNTNVADFILMGLTLSEEIQMALFMLFLLIYLITMLGNVGMILIIRLDLQLHTPMYFFLTHLSFIDLSYSTVVTPKTLANLLTSNYISFTGCFAQMFFFAFLGTAECYLLSSMAHDRYAAICSPLHYTVIMSKRLCLALITGPYVIGFIDSFVNVVSMSRLHFYDSNVIHHFFCDTSPILALSCTDTYNTEILIFIIVGSTLMVSLFTISASYVFILFTILKINSTSGKQKAFSTCVSHLLGVTIFYSTLIFTYLKPRKSYSLGRDQVASVFYTIVIPVLNPLIYSLRNKEVKNAVIRVMQRRQDSR

SEQ ID NO: 394 - DNA, 939 bp, Homo sapiens
atgatgggtagaaggaataacacaaatgtggctgacttcatccttatgggactgacactttctgaagagatccagatggctctgtttatgctatttctcctgatatacctaattactatgctggggaatgtggggatgatattgataatccgcctggacctccagcttcacactcccatgtattttttccttactcacctgtcatttattgacctcagttactcaactgtcgtcacacctaaaaccttagcgaacttactgacttccaactatatttcctttacgggctgctttgcccagatgttcttttttgccttcttgggtactgctgaatgttaccttctctcctcaatggcccatgatcgctatgcagcgatctgcagtcctctacactacacagttattatgtccaaaaggctctgcctcgctctcatcactgggccttatgtgattggctttatagactcctttgtcaacgtggtttccatgagcagattgcatttctacgactcaaacgtaattcatcactttttctgtgacacttccccaattttagctctgtcctgcactgatacatacaacaccgaaatcctgatattcattattgttggttccaccctgatggtgtcccttttcacaatatctgcatcctatgtgttcattctctttaccatcctgaaaattaattccacttcaggaaagcagaaagctttctctacttgcgtctctcatctcttgggagtcaccatcttttatagcactctgatttttacttatttaaaaccaagaaagtcttattccttgggaagagatcaagtggcttctgttttttatactattgtgattcccgtgctgaatccactcatttatagtcttagaaacaaagaggtgaaaaatgctgtcatcagagtcatgcagagaagacaggactccaggtaa

SEQ ID NO: 395 - protein, 310 aa, Homo sapiens
MAGNNFTEVTVFILSGFANHPELQVSLFLMFLFIYLFTVLGNLGLITLIRMDSQLHTPMYFFLSNLAFIDIFYSSTVTPKALVNFQSNRRSISFVGCFVQMYFFVGLVCCECFLLGSMAYNRYIAICNPLLYSVVMSQKVSNWLGVMPYVIGFTSSLISVWVISSLAFCDSSINHFFCDTTALLALSCVDTFGTEMVSFVLAGFTLLSSLLIITVTYIIIISAILRIQSAAGRQKAFSTCASHLMAVTIFYGSLIFTYLQPDNTSSLTQAQVASVFYTIVIPMLNPLIYSLRNKDVKNALLRVIHRKLFP

SEQ ID NO: 396 - DNA, 933 bp, Homo sapiens
atggctggcaacaatttcactgaggttaccgtcttcatcctctctggatttgcaaatcaccctgaattacaagtcagtcttttcttgatgtttctcttcatttatctattcactgttttgggaaacctgggactgatcacgttaatcagaatggattctcagcttcacacccctatgtactttttcctgagcaatttagcatttattgacatattttactcctctactgtaacacctaaggcattggtgaatttccaatccaatcggagatccatctcctttgttggctgctttgttcaaatgtacttttttgttggattggtgtgttgtgagtgtttccttctgggatcaatggcctacaatcgctacatagcaatctgcaatcccttactgtattcagtagtcatgtcccaaaaagtgtccaactggctgggagtaatgccatatgtgataggcttcacaagctcgctgatatctgtctgggtgataagcagtttggcgttctgtgattccagcatcaatcattttttttgtgacaccacagctcttttagcactctcctgtgtagatacattcggcacagaaatggtgagctttgtcttagctggattcactcttcttagctctctccttatcatcacagtcacttatatcatcatcatctcagccatcctgaggatccagtcagcagcaggcaggcagaaggccttctccacctgcgcatcccacctcatggctgtaactatcttttatgggtctctgattttcacctatttgcaacctgataacacatcatcgctgacccaggcgcaggtggcatctgtattctatacgattgtcattcccatgctgaatccactcatctacagtctgaggaacaaagatgtgaaaaatgctcttctgagagtcatacatagaaaactttttccatga

SEQ ID NO: 397 - protein, 350 aa, Homo sapiens
MNSLGKLVSMILSAHVFCYSKFNCFGCTHSIPALGADPPGGMGLGNESSLMDFILLGFSDHPRLEAVLFVFVLFFYLLTLVGNFTIIIISYLDPPLHTPMYFFLSNLSLLDICFTTSLAPQTLVNLQRPKKTITYGGCVAQLYISLALGSTECILLADMALDRYIAVCKPLHYVVIMNPRLCQQLASISWLSGLASSLIHATFTLQLPLCGNHRLDHFICEVPALLKLACVDTTVNELVLFVVSVLFVVIPPALISISYGFITQAVLRIKSVEARHKAFSTCSSHLTVVIIFYGTIIYVYLQPSDSYAQDQGKFISLFYTMVTPTLNPIIYTLRNKDMKEALRKLLSGKL

SEQ ID NO: 398 - DNA, 1053 bp, Homo sapiens
atgaatagtttgggaaagttggtctccatgatcctctcagctcatgtgttctgttattctaaatttaattgttttggatgtacccattccattcctgccttaggtgcggatccccctggagggatgggattgggcaatgagagttccctaatggatttcatccttctaggcttctcagaccaccctcgtctggaggctgttctctttgtatttgtccttttcttctacctcctgacccttgtgggaaacttcaccataatcatcatctcatatctggatccccctcttcataccccaatgtacttttttctcagcaacctctctttactggacatctgcttcactactagccttgctcctcagaccttagttaacttgcaaagaccaaagaagacgatcacttacggtggttgtgtggcgcaactctatatttctctggcactgggctccactgaatgtatcctcttggctgacatggccttggatcggtacattgctgtctgcaaacccctccactatgtagtcatcatgaacccacggctttgccaacagctggcatctatctcctggctcagtggtttggctagttccctaatccatgcaacttttaccttgcaattgcctctctgtggcaaccataggctggaccattttatttgcgaagtaccagctcttctcaagttggcttgtgtggacaccactgtcaatgaattggtgctttttgttgttagtgttctgtttgttgtcattccaccagcactcatctccatctcctatggcttcataactcaagctgtgctgaggatcaaatcagtagaggcaaggcataaagccttcagcacctgctcctcccaccttacagtggtgattatattctatggcaccataatctacgtgtacctgcaacctagtgacagctatgcccaggaccaagggaagtttatctccctcttctacaccatggtgacccccactttaaatcctatcatctatactttaaggaacaaggatatgaaagaggctctgaggaaacttctctcgggaaaattgtga

SEQ ID NO: 399 - protein, 323 aa, Homo sapiens
MDKSNSSVVSEFVLLGLCSSQKLQLFYFCFFSVLYTVIVLGNLLIILTVTSDTSLHSPMYFLLGNLSFVDICQASFATPKMIADFLSAHETISFSGCIAQIFFIHLFTGGEMVLLVSMAYDRYVAICKPLYYVVIMSRRTCTVLVMISWAVSLVHTLSQLSFTVNLPFCGPNVVDSFFCDLPRVTKLACLDSYIIEILIVVNSGILSLSTFSLLVSSYIIILVTVWLKSSAAMAKAFSTLASHIAVVILFFGPCIFIYVWPFTISPLDKFLAIFYTVFTPVLNPIIYTLRNRDMKAAVRKIVNHYLRPRRISEMSLVVRTSFH

SEQ ID NO: 400 - DNA, 972 bp, Homo sapiens
atggataagtccaattcttcagtggtgtctgaatttgtactgttgggactctgtagttctcaaaaactccagcttttctatttttgtttcttctctgtgttgtatacagtcattgtgctgggaaatcttctcattatcctcacagtgacttctgataccagcctgcactcccctatgtactttctcttgggaaacctttcctttgttgacatttgtcaggcttcttttgctacccctaaaatgattgcagattttctgagtgcacacgagaccatatctttcagtggctgcatagcccaaattttctttattcacctttttactggaggggagatggtgctacttgtttcgatggcctatgacaggtatgtagccatatgcaaacccttatactatgtggtcatcatgagccgaaggacatgcactgtcttggtaatgatctcctgggctgtgagcttggtgcacacattaagccagttatcatttactgtgaacctgcctttttgtggacctaatgtagtagacagctttttttgtgatcttcctcgagtcaccaaacttgcctgcctggactcttacatcattgaaatactaattgtggtcaatagtggaattctttccctaagcactttctctctcttggtcagctcctacatcattattcttgttacagtttggctcaagtcttcagctgcaatggcaaaggcattttctacgctggcttcccatattgcagtagtaatattattctttggaccttgcatcttcatctatgtgtggccctttaccatctctcctttggataaatttcttgccatattttacactgttttcacccccgtcctaaaccccattatttatacactaaggaatagggatatgaaggctgccgtaaggaaaattgtgaaccattacctgaggccaaggagaatttctgaaatgtcactagtagtgagaacttcctttcattaa

SEQ ID NO: 401 - protein, 311 aa, Homo sapiens
MAHTNESMVSEFVLLGLSNSWGLQLFFFAIFSIVYVTSVLGNVLIIVIISFDSHLNSPMYFLLSNLSFIDICQSNFATPKMLVDFFIERKTISFEGCMAQIFVLHSFVGSEMMLLVAMAYDRFIAICKPLHYSTIMNRRLCVIFVSISWAVGVLHSVSHLAFTVDLPFCGPNEVDSFFCDLPLVIELACMDTYEMEIMTLTNSGLISLSCFLALIISYTIILIGVRCRSSSGSSKALSTLTAHITVVILFFGPCIYFYIWPFSRLPVDKFLSVFYTVCTPLLNPIIYSLRNEDVKAAMWKLRNHHVNSWKN

SEQ ID NO: 402 - DNA, 936 bp, Homo sapiens
atggctcacacaaatgaatcgatggtgtctgagtttgtacttttgggactctctaattcctggggacttcaacttttctttttcgccatcttctctatagtctatgtgacatcagtgctaggcaatgtcttaattattgtcattatttcttttgactcccatttgaactctcctatgtacttcttgctcagtaatctttctttcattgatatctgtcagtctaactttgccacccccaagatgcttgtagacttttttattgagcgcaagactatctcctttgagggttgcatggcccagatattcgttcttcacagttttgttgggagtgagatgatgttgcttgtagctatggcatatgacagatttatagccatatgtaagcctctgcactacagtacaattatgaaccggaggctctgtgtaatttttgtgtctatttcctgggcggtgggcgttcttcattctgtgagccacttggcttttacagtggacctgccattctgtggtcccaatgaggtggatagcttcttttgtgaccttcccttggtgatagagctggcttgcatggatacatatgaaatggaaattatgaccctaacgaacagtggcctgatatcattgagctgtttcctggctttaattatttcctacaccatcattttgatcggtgtccgatgcaggtcctccagtgggtcatctaaggctctttctacattaactgcccacatcacagtggtcattcttttcttcgggccttgcatttatttctatatatggccttttagcagacttcctgtggacaaatttctttctgtgttctacactgtttgtactcccttgttgaaccccatcatctactctttgaggaatgaagatgttaaagcagccatgtggaagctgagaaaccatcatgtgaactcctggaaaaactag

SEQ ID NO: 403 - protein, 314 aa, Homo sapiens
MDVGNKSTMSEFVLLGLSNSWELQMFFFMVFSLLYVATMVGNSLIVITVIVDPHLHSPMYFLLTNLSIIDMSLASFATPKMITDYLTGHKTISFDGCLTQIFFLHLFTGTEIILLMAMSFDRYIAICKPLHYASVISPQVCVALVVASWIMGVMHSMSQVIFALTLPFCGPYEVDSFFCDLPVVFQLACVDTYVLGLFMISTSGIIALSCFIVLFNSYVIVLVTVKHHSSRGSSKALSTCTAHFIVVFLFFGPCIFIYMWPLSSFLTDKILSVFYTIFTPTLNPIIYTLRNQEVKIAMRKLKNRFLNFNKAMPS

SEQ ID NO: 404 - DNA, 945 bp, Homo sapiens
atggatgtgggcaataagtctaccatgtctgaatttgttttgctggggctctctaattcctgggaactacagatgtttttctttatggtgttttcattgctttatgtggcaacaatggtgggtaacagcctcatagtcatcacagttatagtggaccctcacctacactctcctatgtatttcctgcttaccaatctttcaatcattgatatgtctcttgcttctttcgccaccccaaagatgattacagattacctaacaggtcacaaaaccatctcttttgatggctgccttacccagatattctttctccaccttttcactggaactgagatcatcttactcatggccatgtcctttgataggtatattgcaatatgcaagcccctgcactatgcttctgtcattagtccccaggtgtgtgttgctctcgtggtggcttcctggattatgggagttatgcattcaatgagtcaggtcatatttgccctcacgttaccattctgtggtccctatgaggtagacagctttttctgtgaccttcctgtggtgttccagttggcttgtgtggatacttatgttctgggcctctttatgatctcaacaagtggcataattgcgttgtcctgttttattgttttatttaattcatatgttattgtcctggttactgtgaagcatcattcttccagaggatcatctaaggccctttctacttgtacagctcatttcattgttgtcttcttgttctttgggccatgcatcttcatctacatgtggccactaagcagctttctcacagacaagattctgtctgtgttttataccatctttactcccactctgaacccaataatctatactttgaggaatcaagaagtaaagatagccatgaggaaactgaaaaataggtttctaaattttaataaggcaatgccttcatag

SEQ ID NO: 405 - protein, 325 aa, Homo sapiens [sequence omitted]

SEQ ID NO: 406 - DNA, 978 bp, Homo sapiens
atgctagagtccttccagaaatcagagcaaatggcctggagcaatcagtctgcggtaaccgaattcatactacggggtctgtccagttctttagaactccagattttctacttcctgtttttctccatagtctatgcagccactgtgctggggaaccttcttattgtggtcaccattgcatcagagccacaccttcattcccctacgtactttctgctgggcaatctctccttcattgacatgtccctggcctcatttgccacccccaaaatgattgcagacttccttagagaacacaaagccatctcttttgaaggctgcatgacccagatgttcttcctacatctcttagggggtgctgagattgtactgctgatctccatgtcctttgataggtacgtggctatctgtaagcctctacattacctaacaatcatgagccgaagaatgtgtgttgggcttgtgatactttcctggattgtcggcatcttccatgctctgagtcagttagcatttacagtgaatctgcccttctgtggacccaatgaagtagacagtttcttttgtgacctccctttggtgattaaacttgcttgtgtcgacacatatattctgggggtgttcatgatctcaaccagtggcatgattgccctggtgtgcttcatcctcttggtgatctcttacactatcatcctggtcaccgttcggcagcgttcctctggtggatcctccaaagccctctccacgtgcagtgcccactttactgttgtgacccttttctttggcccatgcactttcatttatgtgtggcctttcacaaatttcccaatagacaaagtactctcagtattttataccatatacactcccctcttgaatccagtgatctataccgttaggaataaagatgtcaagtattccatgaggaaactaagcagccatatctttaaatctaggaagactgatcatactccttaa

SEQ ID NO: 407 - protein, 313 aa, Homo sapiens [sequence omitted]

SEQ ID NO: 408 - DNA, 942 bp, Homo sapiens
atggaaactgcaaattacaccaaggtgacagaatttgttctcactggcctatcccagactcgggaggtccaactagtcctatttgttatatttctatccttctatttgttcatcctaccaggaaatatccttatcatttgcaccatcaggctagaccctcatctgacttctcctatgtatttcctgttggctaatctggccctccttgatatttggtactcttccattacagcccctaaaatgctcatagacttctttgtggagaggaagataatttcctttggtggatgcattgcacagctcttcttcttacactttgttggggcttcggagatgttcttgctcatagtgatggcctatgaccgctatgctgctatctgccgacccctccactatgctaccatcatgaatcgacgtctctgctgtatcctggtggctctctcctggatggggggcttcattcattctataatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttcattgctctgttaatgtcctatgccttccttctggccttgctcaagaaacattcaggctcagatgagaataccaacagggccatgtccacctgctattcccacattaccattgtggtgctaatgtttgggccatccatctacatttatgctcgcccatttgactcattttccctagataaagtggtgtctgtgtttcatactgtaatattccctttacttaatcccattatttacacattgagaaacaaggaagtaaaggcagccatgaggaaggtggtcaccaaatatattttgtgtgaagagaagtga

SEQ ID NO: 409 - protein, 348 aa, Homo sapiens
MLTSLTDLCFSPIQVAEIKSLPKSMNETNHSRVTEFVLLGLSSSRELQPFLFLTFSLLYLAILLGNFLIILTVTSDSRLHTPMYFLLANLSFIDVCVASFATPKMIADFLVERKTISFDACLAQIFFVHLFTGSEMVLLVSMAYDRYVAICKPLHYMTVMSRRVCVVLVLISWFVGFIHTTSQLAFTVNLPFCGPNKVDSFFCDLPLVTKLACIDTYVVSLLIVADSGFLSLSSFLLLVVSYTVILVTVRNRSSASMAKARSTLTAHITVVTLFFGPCIFIYVWPFSSYSVDKVLAVFYTIFTLILNPVIYTLRNKEVKAAMSKLKSRYLKPSQVSVVIRNVLFLETK

SEQ ID NO: 410 - DNA, 1047 bp, Homo sapiens
atgctcacttcattaactgatctctgtttctctcctattcaggtagctgaaattaagtcccttccaaaatcgatgaatgagacaaatcattctcgggtgacagaatttgtgttgctgggactgtctagttcaagggagctccaacctttcttgtttcttacattttcactactttatctagcaattctgttgggcaactttctcatcatcctcactgtgacctcagattcccgccttcacacccccatgtactttctgcttgcaaacctgtcatttatagacgtatgtgttgcctcttttgctacccctaaaatgattgcagactttctggttgagcgcaagactatttcttttgatgcctgcctggcccagattttctttgttcatctcttcactggcagtgaaatggtgctcctagtttccatggcctatgaccgttatgttgctatatgcaaacctctccactacatgacagtcatgagccgtcgtgtatgtgttgtgctcgtcctcatttcatggtttgtgggcttcatccatactaccagccagttggcattcactgttaatctgccattttgtggtcctaataaggtagacagttttttctgtgaccttcctctagtgaccaagttagcctgcatagacacttatgttgtcagcttactaatagttgcagatagtggctttctttctctgagttcctttctcctcttggttgtctcctacactgtaatacttgttacagttaggaatcgctcctctgcaagcatggcgaaggcccgctccacattgactgctcacatcactgtggtcactttattctttggaccatgcattttcatctatgtgtggcccttcagcagttactcagttgacaaagtccttgctgtattctacaccatcttcacgcttattttaaaccctgtaatctacacgctaagaaacaaagaagtgaaggcagctatgtcaaaactgaagagtcggtatctgaagcctagtcaggtttctgtagtcataagaaatgttcttttcctagaaacaaagtaa

SEQ ID NO: 411 - protein, 343 aa, Homo sapiens
MKQYSVGNQHSNYRSLLFPFLCSQMTQLTASGNQTMVTEFLFSMFPHAHRGGLLFFIPLLLIYGFILTGNLIMFIVIQVGMALHTPLYFFISVLSFLEICYTTTTIPKMLSCLISEQKSISVAGCLLQMYFFHSLGITESCVLTAMAIDRYIAICNPLRYPTIMIPKLCIQLTVGSCFCGFLLVLPEIAWISTLPFCGSNQIHQIFCDFTPVLSLACTDTFLVVIVDAIHAAEIVASFLVIALSYIRIIIVILGMHSAEGHHKAFSTCAAHLAVFLLFFGSVAVMYLRFSATYSVFWDTAIAVTFVILAPFFNPIIYSLKNKDMKEAIGRLFHYQKRAGWAGK

SEQ ID NO: 412 - DNA, 1032 bp, Homo sapiens
atgaagcaatattcagtgggtaatcaacattccaattataggagtctcttgtttccttttctgtgttcacagatgacacagttgacggccagtgggaatcagacaatggtgactgagttcctcttctctatgttcccgcatgcgcacagaggtggcctcttattctttattcccttgcttctcatctacggatttatcctaactggaaacctaataatgttcattgtcatccaggtgggcatggccctgcacacccctttgtatttctttatcagtgtcctctccttcctggagatctgctataccacaaccaccatccccaagatgctgtcctgcctaatcagtgagcagaagagcatttccgtggctggctgcctcctgcagatgtactttttccactcacttggtatcacagaaagctgtgtcctgacagcaatggccattgacaggtacatagctatctgcaatccactccgttacccaaccatcatgattcccaaactttgtatccagctgacagttggatcctgcttttgtggcttcctccttgtgcttcctgagattgcatggatttccaccttgcctttctgtggctccaaccagatccaccagatattctgtgatttcacacctgtgctgagcttggcctgcacagatacattcctagtggtcattgtggatgccatccatgcagcggaaattgtagcctccttcctggtcattgctctatcctacatccggattattatagtgattctgggaatgcactcagctgaaggtcatcacaaggccttttccacctgtgctgctcaccttgctgtgttcttgctattttttggcagtgtggctgtcatgtatttgagattctcagccacctactcagtgttttgggacacagcaattgctgtcacttttgttatccttgctccctttttcaaccccatcatctatagcctgaaaaacaaggacatgaaagaggctattggaaggcttttccactatcagaagagggctggttgggctgggaaatag

SEQ ID NO: 413 - protein, 317 aa, Homo sapiens
MRNLSGGHVEEFVLVGFPTTPPLQLLLFVLFFAIYLLTLLENALIVFTIWLAPSLHRPMYFFLGHLSFLELWYINVTIPRLLAAFLTQDGRVSYVGCMTQLYFFIALACTECVLLAVMAYDRYLAICGPLLYPSLMPSSLATRLAAASWGSGFFSSMMKLLFISQLSYCGPNIINHFFCDISPLLNLTCSDKEQAELVDFLLALVMILLPLLAVVSSYTAIIAAILRIPTSRGRHKAFSTCAAHLAVVVIYYSSTLFTYARPRAMYTFNHNKIISVLYTIIVPFFNPAIYCLRNKEVKEAFRKTVMGRCHYPRDVQD

SEQ ID NO: 414 - DNA, 954 bp, Homo sapiens
atgagaaatttgagtggaggccatgtcgaggagtttgtcttggtgggtttccctaccacgcctcccctccagctgctcctctttgtccttttttttgcaatttaccttctgacattgttggagaatgcacttattgtcttcacaatatggcttgctccaagccttcatcgtcccatgtactttttccttggccatctctctttcctggagctatggtacatcaatgtcaccattcctcggctcttggcagcctttcttacccaggatggtagagtctcctacgtaggttgcatgacccaactgtacttctttattgccttagcctgtactgaatgtgtgctgttggcagttatggcctatgatcgctacctggccatctgtggacccctcctttaccctagtctcatgccttccagtctggccactcgccttgctgctgcctcttggggcagtggcttcttcagctccatgatgaagcttctttttatttcccaattgtcctactgtggacccaacattatcaaccactttttctgtgatatttccccactactcaacctcacctgctctgacaaggagcaagcagagctagtagacttccttctggccctggtgatgattctactccctctattggctgtggtttcatcatacactgccatcattgcagccatcctgaggatccctacgtccaggggacgccacaaagccttttccacttgtgccgctcatctggcagtggttgttatctactactcctccactctcttcacctatgcacggccccgggccatgtacaccttcaaccacaacaagattatctctgtgctctacactatcattgtaccattcttcaacccagccatctactgcctgaggaacaaggaggtgaaggaggccttcaggaagacagtgatgggcagatgtcactatcctagggatgttcaggactga

SEQ ID NO: 415 - protein, 313 aa, Homo sapiens [sequence omitted]

SEQ ID NO: 416 - DNA, 942 bp, Homo sapiens
atggggcagaccaacgtaacctcctggagggattttgtcttcctgggcttctccagttctggggagttgcagctccttctctttgccttgttcctctctctgtatctagtcactctgaccagcaatgtcttcattatcatagccatcaggctggatagccatctgcacacccccatgtacctcttcctttccttcctatccttctctgagacctgctacactttgggcatcatccctagaatgctctctggcctggctgggggggaccaggctatctcctatgtgggctgtgctgcccagatgttcttttctgcctcatgggcctgtactaactgcttccttctggctgccatgggctttgacagatatgtggccatctgtgctccactccactatgccagccacatgaatcctaccctctgtgcccagctggtcattacttccttcctgactggatacctctttggactgggaatgacactagttattttccacctctcattctgcagctcccatgaaatccagcactttttttgtgacacgccacctgtgctgagcctagcctgtggagatacaggcccgagtgagctgaggatctttatcctcagtcttttggtcctcttggtctccttcttcttcatcaccatctcctacgcctacatcttggcagcaatactgaggatcccctctgctgaggggcagaagaaggccttctccacttgtgcctcgcaccttacagtggtcattattcattatggctgtgcttccttcgtgtacctgaggcccaaagccagctactctcttgagagagatcagcttattgccatgacctatactgtagtgacccccctccttaatcccattgtttatagtctaaggactagggctatacagacagctctgaggaatgctttcagagggagattgctgggtaaaggatga

SEQ ID NO: 417 - protein, 316 aa, Homo sapiens
MEAANESSEGISFVLLGLTTSPGQQRPLFVLFLLLYVASLLGNGLIVAAIQASPALHAPMYFLLAHLSFADLCFASVTVPKMLANLLAHDHSISLAGCLTQMYFFFALGVTDSCLLAAMAYDCYVAIRHPLPYATRMSRAMCAALVGMAWLVSHVHSLLYILLMARLSFCASHQVPHFFCDHQPLLRLSCSDTHHIQLLIFTEGAAVVVTPFLLILASYGAIAAAVLQLPSASGRLRAVSTCGSHLAVVSLFYGTVIAVYFQATSRREAEWGRVATVMYTVVTPMLNPIIYSLWNRDVQGALRALLIGRRISASDS

SEQ ID NO: 418 - DNA, 951 bp, Homo sapiens
atggaggctgccaatgagtcttcagagggaatctcattcgttttattgggactgacaacaagtcctggacagcagcggcctctctttgtgctgttcttgctcttgtatgtggccagcctcctgggtaatggactcattgtggctgccatccaggccagtccagcccttcatgcacccatgtacttcctgctggcccacctgtcctttgctgacctctgtttcgcctccgtcactgtgcccaagatgttggccaacttgttggcccatgaccactccatctcgctggctggctgcctgacccaaatgtacttcttctttgccctgggggtaactgatagctgtcttctggcggccatggcctatgactgctacgtggccatccggcaccccctcccctatgccacgaggatgtcccgggccatgtgcgcagccctggtgggaatggcatggctggtgtcccacgtccactccctcctgtatatcctgctcatggctcgcttgtccttctgtgcttcccaccaagtgccccacttcttctgtgaccaccagcctctcttaaggctctcgtgctctgacacccaccacatccagctgctcatcttcaccgagggcgccgcagtggtggtcactcccttcctgctcatcctcgcctcctatggggccatcgcagctgccgtgctccagctgccctcagcctctgggaggctccgggctgtgtccacctgtggctcccacctggctgtggtgagcctcttctatgggacagtcattgcagtctacttccaggccacatcccgacgcgaggcagagtggggccgtgtggccactgtcatgtacactgtagtcacccccatgctgaaccccatcatctacagcctctggaatcgcgatgtacagggggcactccgagcccttctcattgggcgaaggatctcagctagtgactcctga

SEQ ID NO: 419 - protein, 311 aa, Homo sapiens
MGSFNTSFEDGFILVGFSDWPQLEPILFVFIFIFYSLTLFGNTIIIALSWLDLRLHTPMYFFLSHLSLLDLCFTTSTVPQLLINLCGVDRTITRGGCVAQLFIYLALGSTECVLLVVMAFDRYAAVCRPLHYMAIMHPHLCQTLAIASWGAGFVNSLIQTGLAMAMPLCGHRLNHFFCEMPVFLKLACADTEGTEAKMFVARVIVVAVPAALILGSYVHIAHAVLRVKSTAGRRKAFGTCGSHLLVVFLFYGSAIYTYLQSIHNYSEREGKFVALFYTIITPILNPLIYTLRNKDVKGALWKVLWRGRDSG

SEQ ID NO: 420 - DNA, 936 bp, Homo sapiens
atgggaagtttcaacaccagttttgaagatggcttcattttggtgggattctcagattggccgcaactggagcccatcctgtttgtctttatttttattttctactccctaactctctttggcaacaccatcatcatcgctctctcctggctagaccttcggctgcacacacctatgtacttctttctctctcatctgtccctcctggacctctgcttcaccaccagcaccgtgccccagctcctgatcaacctttgcggggtggaccgcaccatcacccgtggagggtgtgtggctcagctcttcatctacctagccctgggctccacagagtgtgtgctcctggtggtgatggcctttgaccgctatgctgctgtctgtcgtccactccactacatggccatcatgcacccccatctctgccagaccctggctatcgcctcctggggtgcgggtttcgtgaactctctgatccagacaggtctcgcaatggccatgcctctctgtggccatcgactgaatcacttcttctgtgagatgcctgtatttctgaagttggcttgtgcggacacagaaggaacagaggccaagatgtttgtggcccgagtcatagtcgtggctgttcctgcagcacttattctaggctcctatgtgcacattgctcatgcagtgctgagggtgaagtcaacggctgggcgcagaaaggcttttgggacttgtgggtcccacctcctagtagttttccttttttatggctcagccatctacacatatctccaatccatccacaattattctgagcgtgagggaaaatttgttgcccttttttatactataattacccccattctcaatcctctcatttatacactaagaaacaaggacgtgaagggggctctgtggaaagtactatggaggggcagggactcagggtag

SEQ ID NO: 421 - protein, 312 aa, Homo sapiens
MENYNQTSTDFILLGLFPPSIIDLFFFILIVFIFLMALIGNLSMILLIFLDTHLHTPMYFLLSQLSLIDLNYISTIVPKMASDFLHGNKSISFTGCGIQSFFFLALGGAEALLLASMAYDRYIAICFPLHYLIRMSKRVCVLMITGSWIIGSINACAHTVYVLHIPYCRSRAINHFFCDVPAMVTLACMDTWVYEGTVFLSATIFLVFPFIGISCSYGQVLFAVYHMKSAEGRKKAYLTCSTHLTVVTFYYAPFVYTYLRPRSLRSPTEDKVLAVFYTILTPMLNPIIYSLRNKEVMGALTRVSQRICSVKM

SEQ ID NO: 422 - DNA, 939 bp, Homo sapiens
atggaaaattacaatcaaacatcaactgatttcatcttattggggctgtttccaccatcaataattgaccttttcttcttcattctcattgttttcattttcctgatggctctaattggaaacctgtccatgattcttctcatcttcttggacacccatctccacacacccatgtatttcctactgagtcagctctccctcattgacctaaattacatctccaccattgttcctaagatggcatctgattttctgcatggaaacaagtctatctccttcactgggtgtgggattcagagtttcttcttcttggcattaggaggtgcagaagcactacttttggcatctatggcctatgatcgttacattgctatttgctttcctctccactatctcatccgcatgagcaaaagagtgtgtgtgctgatgataacagggtcttggatcataggctcgatcaatgcttgtgctcacactgtatatgtactccatattccttattgccgatccagggccatcaatcatttcttctgtgatgtcccagcaatggtgactctggcctgcatggacacctgggtctatgagggcacagtgtttttgagtgccaccatctttctcgtgtttcccttcattggtatttcatgttcctatggccaggttctctttgctgtctaccacatgaaatctgcagaagggaggaagaaagcctatttgacctgcagcacccacctcactgtagtaactttctactatgcaccttttgtctacacttatctacgtccaagatccctgcgatctccaacagaggacaaggttctggctgtcttctacaccatcctcaccccaatgctcaaccccatcatctatagcctgaggaacaaggaggtgatgggggccctgacacgagtgagtcagagaatctgctctgtgaaaatgtag

SEQ ID NO: 423 - protein, 327 aa, Homo sapiens
MEWRNHSGRVSEFVLLGFPAPAPLQVLLFALLLLAYVLVLTENTLIIMAIRNHSTLHKPMYFFLANMSFLEIWYVTVTIPKMLAGFVGSKQDHGQLISFEGCMTQLYFFLGLGCTECVLLAVMAYDRYMAICYPLHYPVIVSGRLCVQMAAGSWAGGFGISMVKVFLISGLSYCGPNIINHFFCDVSPLLNLSCTDMSTAELTDFILAIFILLGPLSVTGASYVAITGAVMHISSAAGRYKAFSTCASHLTVVIIFYAASIFIYARPKALSAFDTNKLVSVLYAVIVPLLNPIIYCLRNQEVKRALCCTLHLYQHQDPDPKKASRNV

SEQ ID NO: 424 - DNA, 984 bp, Homo sapiens
atggagtggcggaaccatagtgggagagtgagtgagtttgtgttgctgggcttccctgctcctgcgccactacaggtactattgtttgcccttttgctgctggcctatgtgttggtgctgactgagaacacactcatcattatggcaattaggaaccattctaccctccacaaacccatgtacttttttctagctaatatgtcctttctggagatctggtatgtcactgtcactattcccaagatgcttgctggctttgttggatccaaacaggatcatggacagctaatctcctttgagggatgcatgacacagctctactttttccttggcttgggctgcactgagtgtgtccttctcgctgttatggcctatgatcgctatatggccatctgctatcctctccactacccagtcattgtcagtggccggctgtgtgtgcagatggctgctggctcttgggctggaggttttggcatctccatggtcaaagtttttcttatttctggcctctcttactgtggccccaacatcatcaaccactttttctgtgatgtctctccattgctcaacctctcatgcactgatatgtccacagcagagcttacagatttcatcctggccatttttattcttctagggccactctctgtcactggggcctcctatgtggccattactggtgctgtgatgcacatatcttcggctgctggacgctataaggccttttccacctgtgcctctcatctcactgttgtgataatcttctatgcagccagtatcttcatctatgctcggccaaaggcactctcagcttttgacaccaacaagttggtctctgtactgtatgctgtcattgtaccattgctcaatcccatcatttactgcctgcgcaatcaagaggtcaagagagccctatgctgtactctgcacctgtaccagcaccaggatcctgaccccaagaaagctagcagaaatgtatag

SEQ ID NO: 425 - protein, 322 aa, Homo sapiens [sequence omitted]

SEQ ID NO: 426 - DNA, 969 bp, Homo sapiens
atggagccccaaaatacctccactgtgactaactttcagctgttaggattccagaaccttcttgaatggcaggccctgctctttgtcattttcctgctcatctactgcctgaccattatagggaatgttgtcatcatcaccgtggtgagccagggcctgcgactgcactcccctatgtacatgttcctccagcatctctcctttctggaggtctggtacacgtccaccactgtgccccttctcctagccaacctgctgtcctggggccaagccatctccttctctgcctgcatggcacagctctacttcttcgtattcctcggcgccaccgagtgctttctcctggccttcatggcctatgaccgttacctggccatctgcagcccactccgctacccctttctcatgcatcgtgggctatgtgccaggttggtggtggtctcatggtgcacaggggtcagcacaggctttctgcattccatgatgatttccaggttggacttctgtgggcgcaatcagattaaccatttcttctgcgacctcccgccactcatgcagctctcctgttccagagtttatatcaccgaggtgaccatcttcatcctgtcaattgccgtgctgtgcatttgtttttttctgacactggggccctatgttttcattgtgtcctccatattgagaatcccttccacctctggccggagaaagaccttttccacatgtggctcccacctggctgttgtcactctctactacgggaccatgatctccatgtatgtgtgtcccagtccccacctgttgcctgaaatcaacaagatcatttctgtcttctacactgtggtcacaccactgctgaacccagttatctacagcttgaggaacaaagacttcaaagaagctgttagaaaggtcatgagaaggaaatgtggtattctatggagtacaagtaaaaggaagttcctttattag

SEQ ID NO: 427 - protein, 338 aa, Homo sapiens
MFYVNQIPFQLYHISFVYPTELWSRAIIPCMPTLSFWVCSATPVSPGFFALILLVFVTSIASNVVKIILIHIDSRLHTPMYFLLSQLSLRDILYISTIVPKMLVDQVMSQRAISFAGCTAQHFLYLTLAGAEFFLLGLMSCDRYVAICNPLHYPDLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRRKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 428 - DNA, 1017 bp, Homo sapiens
atgttttatgtaaatcagatacctttccaactttatcatatctctttcgtgtaccctacagagctatggagcagagcaattattccgtgtatgccgactttatccttctgggtttgttcagcaacgcccgtttcccctggcttctttgccctcattctcctggtctttgtgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctgtgatcgctacgtagccatctgcaaccctctgcactatcctgacctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtgatctcgggctcttacacaagaattctcattactgtttataggatgagcgaggcagaggggaggcgaaaggctgtggccacctgctcctcacacatggtggttgtcagcctcttctatggggctgccatgtacacatacgtgctgcctcattcttaccacacccctgagcaggacaaagctgtatctgccttctacaccatcctcactcccatgctcaatccactcatttacagccttaggaacaaggatgtcacgggggccctacagaaggttgttgggaggtgtgtgtcctcaggaaaggtaaccactttctaa

SEQ ID NO: 429 - protein, 324 aa, Homo sapiens
MGMEGLLQNSTNFVLTGLITHPAFPGLLFAIVFSIFVVAITANLVMILLIHMDSRLHTPMYFLLSQLSIMDTIYICITVPKMLQDLLSKDKTISFLGCAVQIFLYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 430 - DNA, 975 bp, Homo sapiens
atgggcatggagggtcttctccagaactccactaacttcgtcctcacaggcctcatcacccatcctgccttccccgggcttctctttgcaatagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcagatcttcctctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtctcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctag

SEQ ID NO: 431 - protein, 975 aa, Homo sapiens
ATGGGCATGGAGGGTCTTCTCCAGAACTCCACTAACTTCGTCCTCACAGGCCTCATCACCCATCCTGCCTTCCCCGGGCTTCTCTTTGCAATAGTCTTCTCCATCTTTGTGGTGGCTATAACAGCCAACTTGGTCATGATTCTGCTCATCCACATGGACTCCCGCCTCCACACACCCATGTACTTCTTGCTCAGCCAGCTCTCCATCATGGATACCATCTACATCTGTATCACTGTCCCCAAGATGCTCCAGGACCTCCTGTCCAAGGACAAGACCATTTCCTTCCTGGGCTGTGCAGTTCAGATCTTCCTCTACCTGACCCTGATTGGAGGGGAATTCTTCCTGCTGGGTCTCATGGCCTATGACCGCTATGTGGCTGTGTGCAACCCTCTACGGTACCCTCTCCTCATGAACCGCAGGGTTTGCTTATTCATGGTGGTCGGCTCCTGGGTTGGTGGTTCCTTGGATGGGTTCATGCTGACTCCTGTCACTATGAGTTTCCCCTTCTGTAGATCCCGAGAGATCAATCACTTTTTCTGTGAGATCCCAGCCGTGCTGAAGTTGTCTTGCACAGACACGTCACTCTATGAGACCCTGATGTATGCCTGCTGCGTGCTGATGCTGCTTATCCCTCTATCTGTCATCTCTGTCTCCTACACGCACATCCTCCTGACTGTCCACAGGATGAACTCTGCTGAGGGCCGGCGCAAAGCCTTTGCTACGTGTTCCTCCCACATTATGGTGGTGAGCGTTTTCTACGGGGCAGCCTTCTACACCAACGTGCTGCCCCACTCCTACCACACTCCAGAGAAAGATAAAGTGGTGTCTGCCTTCTACACCATCCTCACCCCCATGCTCAACCCACTCATCTACAGCTTGAGGAATAAAGATGTGGCTGCAGCTCTGAGGAAAGTACTAGGGAGATGTGGTTCCTCCCAGAGCATCAGGGTGGCGACTGTGATCAGGAAGGGCTAG

SEQ ID NO: 432 - DNA, 915 bp, Homo sapiens
atggaaagagcaaaccattcagtggtatcggaatttattttgttgggactttccaaatctcaaaatcttcagattttattcttcttgggattctctgtggtcttcgtggggattgtgttaggaaacctgctcatcttggtgactgtgacctttgattcgctccttcacacaccaatgtattttctgcttagcaacctctcctgcattgatatgatcctggcttcttttgctacccctaagatgattgtagatttcctccgagaacgtaagaccatctcatggtggggatgttattcccagatgttctttatgcacctcctgggtgggagtgagatgatgttgcttgtagccatggcaatagacaggtatgttgccatatgcaaacccctccattacatgaccatcatgagcccacgggtgctcactgggctactgttatcctcctatgcagttggatttgtgcactcatctagtcaaatggctttcatgttgactttgcccttctgtggtcccaatgttatagacagctttttctgtgaccttccccttgtgattaaacttgcctgcaaggacacctacatcctacagctcctggtcattgctgacagtgggctcctgtcactggtctgcttcctcctcttgcttgtctcctatggagtcataatattctcagttaggtaccgtgctgctagtcgatcctctaaggctttctccactctctcagctcacatcacagttgtgactctgttctttgctccgtgtgtctttatctacgtctggcccttcagcagatactcggtagataaaattctttctgtgttttacacaattttcacacctctcttaaatcctattatttatacattaagaaatcaagaggtaaaagcagccattaaaaaaagactctgcatataa

SEQ ID NO: 433 - protein, 348 aa, Homo sapiens
MDNITWMASHTGWSDFILMGLFRQSKHPMANITWMANHTGWSDFILLGLFRQSKHPALLCVVIFVVFLMALSGNAVLILLIHCDAHLHTPMYFFISQLSLMDMAYISVTVPKMLLDQVMGVNKISAPECGMQMFFYVTLAGSEFFLLATMAYDRYVAICHPLRYPVLMNHRVCLFLSSGCWFLGSVDGFTFTPITMTFPFRGSREIHHFFCEVPAVLNLSCSDTSLYEIFMYLCCVLMLLIPVVIISSSYLLILLTIHGMNSAEGRKKAFATCSSHLTVVILFYGAAIYTYMLPSSYHTPEKDMMVSVFYTILTPVVNPLIYSLRNKDVMGALKKMLTVEPAFQKAME

SEQ ID NO: 434 - DNA, 1047 bp, Homo sapiens
atggacaacatcacctggatggccagccacactggatggtcggatttcatcctgatgggactcttcagacaatccaaacatccaatggccaatatcacctggatggccaaccacactggatggtcggatttcatcctgttgggactcttcagacaatccaaacatccagcactactttgtgtggtcatttttgtggttttcctgatggcgttgtctggaaatgctgtcctgatccttctgatacactgtgacgcccacctccacacccccatgtactttttcatcagtcaattgtctctcatggacatggcgtacatttctgtcactgtgcccaagatgctcctggaccaggtcatgggtgtgaataagatctcagcccctgagtgtgggatgcagatgttcttctacgtgacactagcaggttcagaatttttccttctagccaccatggcctatgaccgctacgtggccatctgccatcctctccgttaccctgtcctcatgaaccatagggtgtgtctcttcctgtcatcaggctgctggttcctgggctcagtggatggcttcacattcactcccatcaccatgaccttccccttccgtggatcccgggagattcatcatttcttctgtgaagttcctgctgtattgaatctctcctgctcagacacctcactctatgagattttcatgtacttgtgctgtgtcctcatgctcctcatccctgtggtgatcatttcaagctcctatttactcatcctcctcaccatccacgggatgaactcagcagagggccggaaaaaggcctttgccacctgctcctcccacctgactgtggtcatcctcttctatggggctgccatctacacctacatgctccccagctcctaccacacccctgagaaggacatgatggtatctgtcttctataccatcctcactccagtggtgaaccctttaatctatagtcttaggaataaggatgtcatgggggctctgaagaaaatgttaacagtggaacctgcctttcaaaaagctatggagtag

SEQ ID NO: 435 - protein, 315 aa, Homo sapiens
MANITRMANHTGKLDFILMGLFRRSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 436 - DNA, 948 bp, Homo sapiens
atggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttag

SEQ ID NO: 437 - protein, 312 aa, Homo sapiens
MPNSTTVMEFLLMRFSDVWTLQILHSASFFMLYLVTLMGNILIVTVTTCDSSLHMPMYFFLRNLSILDACYISVTVPTSCVNSLLDSTTISKAGCVAQVFLVVFFVYVELLFLTIMAHDRYVAVCQPLHYPVIVNSRICIQMTLASLLSGLVYAGMHTGSTFQLPFCRSNVIHQFFCDIPSLLKLSCSDTFSNEVMIVVSALGVGGGCFIFIIRSYIHIFSTVLGFPRGADRTKAFSTCIPHILVVSVFLSSCSSVYLRPPAIPAATQDLILSGFYSIMPPLFNPIIYSLRNKQIKVAIKKIMKRIFYSENV

SEQ ID NO: 438 - DNA, 939 bp, Homo sapiens
atgcccaattcaaccaccgtgatggaatttctcctcatgaggttttctgatgtgtggacactacagattttacattctgcatccttctttatgttgtatttggtaactctaatgggaaacatcctcattgtgaccgtcaccacctgtgacagcagccttcacatgcccatgtacttcttcctcaggaatctgtctatcttggatgcctgctacatttctgttacagtccctacctcatgtgtcaattccctactggacagcaccaccatttctaaggcgggatgtgtagctcaggtcttcctcgtggttttttttgtatatgtggagcttctgtttctcaccattatggctcatgaccgctatgtggctgtctgccagccacttcactaccctgtgatcgtgaactctcgaatctgcatccagatgacactggcctccctactcagtggtcttgtctatgcaggcatgcacactggcagcacattccagctgcccttctgtcggtccaacgttattcatcaattcttctgtgacatcccctctctgctgaagctctcttgctctgacaccttcagcaatgaggtcatgattgttgtctctgctctgggggtaggtggcggctgtttcatctttatcatcaggtcttacattcacatcttttcgaccgtgctcgggtttccaagaggagcagacagaacaaaggccttttccacctgcatccctcacatcctggtggtgtcagtcttcctcagttcatgctcttctgtgtacctcaggccacctgcgatacctgcagccacccaggatctgatcctttctggtttttattccataatgcctcccctctttaaccctattatttacagtcttagaaataagcaaataaaggtggccatcaagaaaatcatgaagagaattttttattcagaaaatgtgtaa

SEQ ID NO: 439 - protein, 312 aa, Homo sapiens
MDGVNDSSLQGFVLMGISDHPQLEMIFFIAILFSYLLTLLGNSTIILLSRLEARLHTPMYFFLSNLSSLDLAFATSSVPQMLINLWGPGKTISYGGCITQLYVFLWLGATECILLVVMAFDRYVAVCRPLRYTAIMNPQLCWLLAVIACLGGLGNSVIQSTFTLQLPLCGHRRVEGFLCEVPAMIKLACGDTSLNQAVLNGVCTFFTAVPLSIIVISYCLIAQAVLKIRSAEGRRKAFNTCLSHLLVVFLFYGSASYGYLLPAKNSKQDQGKFISLFYSLVTPMVNPLIYTLRNMEVKGALRRLLGKGREVG

SEQ ID NO: 440 - DNA, 939 bp, Homo sapiens
atggacggggtgaatgatagctccttgcagggctttgttctgatgggcatatcagaccatccccagctggagatgatcttttttatagccatcctcttctcctatttgctgaccctacttgggaactcaaccatcatcttgctttcccgcctggaggcccggctccatacacccatgtacttcttcctcagcaacctctcctccttggaccttgctttcgctactagttcagtcccccaaatgctgatcaatttatggggaccaggcaagaccatcagctatggtggctgcataacccagctctatgtcttcctttggctgggggccaccgagtgcatcctgctggtggtgatggcatttgaccgctacgtggcagtgtgccggcccctccgctacaccgccatcatgaacccccagctctgctggctgctggctgtgattgcctgcctgggtggcttgggcaactctgtgatccagtcaacattcactctgcagctcccattgtgtgggcaccggagggtggagggattcctctgcgaggtgcctgccatgatcaaactggcctgtggcgacacaagtctcaaccaggctgtgctcaatggtgtctgcaccttcttcactgcagtcccactaagcatcatcgtgatctcctactgcctcattgctcaggcagtgctgaaaatccgctctgcagaggggaggcgaaaggcgttcaatacgtgcctctcccatctgctggtggtgttcctcttctatggctcagccagctatgggtatctgcttccggccaagaacagcaaacaggaccagggcaagttcatttccctgttctactcgttggtcacacccatggtgaatcccctcatctacacgctgcggaacatggaagtgaagggcgcactgaggaggttgctggggaaaggaagagaagttggctga

SEQ ID NO: 441 - protein, 352 aa, Homo sapiens [sequence omitted]

SEQ ID NO: 442 - DNA, 1059 bp, Homo sapiens
atgacatctcaggaaagggatacagctatttattccattaatgtcagttttgttgcaaaggggatgactagccgctctgtgtgtgagaagatgaccatgacaacggagaaccccaaccagactgtggtgagccacttcttcctggagggtttgaggtacaccgctaaacattctagcctcttcttcctcctcttcctcctcatctacagcatcactgtggctgggaatctcctcatcctcctaactgtgggctctgactctcacctcagcttacccatgtaccacttcctggggcacctctccttcctggatgcctgtttgtctacagtgacagtgcccaaggtcatggcaggcctgctgactctggatgggaaggtgatctcctttgagggctgtgccgtacagctttattgcttccactttctggccagcactgagtgcttcctgtacacagtcatggcctatgaccgctatctggctatctgtcaacccctgcactacccagtggccatgaacagaaggatgtgtgcagaaatggctggaatcacctgggccataggtgccacgcacgctgcaatccacacctccctcaccttccgcctgctctactgtgggccttgccacattgcctacttcttctgcgacataccccctgtcctaaagctcgcctgtacagacaccaccattaatgagctagtcatgcttgccagcattggcatcgtggctgcaggctgcctcatcctcatcgttatttcctacatcttcatcgtggcagctgtgttgcgcatccgcacagcccagggccggcagcgggccttctccccctgcactgcccagctcactggggtgctcctgtactacgtgccacctgtctgtatctacctgcagcctcgctccagtgaggcaggagctggggcccctgctgtcttctacacaatcgtaactccaatgctcaacccattcatttacactttgcggaacaaggaggtgaagcatgctctgcaaaggcttttgtgcagcagcttccgagagtctacagcaggcagcccacccccatag

SEQ ID NO: 443 - protein, 314 aa, Homo sapiens [sequence omitted]

SEQ ID NO: 444 - DNA, 945 bp, Homo sapiens
atggatcagagaaattacaccagagtgaaagaatttaccttcctgggaattactcagtcccgagaactgagccaggtcttatttaccttcctgtttttggtgtacatgacaactctaatgggaaacttcctcatcatggttacagttacctgtgaatctcaccttcatacgcccatgtacttcctgctccgcaacctgtctattcttgacatctgcttttcctccatcacagctcctaaggtcctgatagatcttctatcagagacaaaaaccatctccttcagtggctgtgtcactcaaatgttcttcttccaccttctggggggagcagacgttttttctctctctgtgatggcgtttgaccgctatatagccatctccaagcccctgcactatatgaccatcatgagtagggggcgatgcacaggcctcatcgtgggcttcctgggtggggggcttgtccactccatagcgcagatttctctattgctcccactccctgtctgtggacccaatgttcttgacactttctactgcgatgtcccccaggtcctcaaacttgcctgcactgacaccttcactctggagctcctgatgatttcaaataatgggttagtcagttggtttgtattcttctttctcctcatatcttacacggtcatcttgatgatgctgaggtctcacactggggaaggcaggaggaaagccatctccacctgcacctcccacatcaccgtggtgaccctgcatttcgtgccctgcatctatgtctatgcccggcccttcactgccctccccacagacactgccatctctgtcaccttcactgtcatctcccctttgctcaatcctataatttacacgctgaggaatcaggaaatgaagttggccatgaggaaactgaagagacggctaggacaatcagaaaggattttaattcaataa

SEQ ID NO: 445 - protein, 315 aa, Homo sapiens [sequence omitted]

SEQ ID NO: 446 - DNA, 948 bp, Homo sapiens
atggctcctgaaaatttcaccagggtcactgagtttattctcacaggtgtctctagctgtccagagctccagattcccctcttcctggtcttcctagtgctctatgtgctgaccatggcagggaacctgggcatcatcaccctcaccagtgttgactctcgacttcaaacccccatgtactttttcctgagacatctagctatcatcaatcttggcaactctactgtcattgcccctaaaatgctgatgaactttttagtaaagaagaaaactacctcattctatgaatgtgccacccaactgggagggttcttgttctttattgtatcggaggtaatgatgctggctgtgatggcctatgaccgctatgtggccatttgtaaccctctgctctacatggtggtggtgtctcggcggctctgcctcctgctggtgtccctcacgtacctctatggcttttctacagctattgtggtttcaccttgtatattctctgtgtcttattgctcttctaatataatcaatcatttttactgtgatattgcacctctgttagcattatcttgctctgatacttacataccagaaacaatagtctttatatctgcagcaacaaatttgtttttttccatgattacagttctagtatcttatttcaatattgttttgtccattctaaggatacgttcaccagaaggaaggaaaaaagccttttccacctgcgcttcgcatatgatagcagtcacggttttctatgggacaatgctatttatgtatttgcagccccaaaccaaccactcactggatactgataagatggcttctgtgttttacacattggtgattcctatgctgaatcccttgatctacagcctgaggaataatgatgtaaatgttgccttaaagaaattcatggaaaatccatgttactcctttaaatcaatgtaa

SEQ ID NO: 447 - protein, 310 aa, Homo sapiens
MDPQNYSLVSEFVLHGLCTSRHLQNFFFIFFFGVYVAIMLGNLLILVTVISDPCLHSSPMYFLLGNLAFLDMWLASFATPKMIRDFLSDQKLISFGGCMAQIFFLHFTGGAEMVLLVSMAYDRYVAICKPLHYMTLMSWQTCIRLVLASWVVGFVHSISQVAFTVNLPYCGPNEVDSFFCDLPLVIKLACMDTYVLGIIMISDSGLLSLSCFLLLLISYTVILLAIRQRAAGSTSKALSTCSAHIMVVTLFFGPCIFVYVRPFSRFSVDKLLSVFYTIFTPLLNPIIYTLRNEEMKAAMKKLQNRRVTFQ

SEQ ID NO: 448 - DNA, 933 bp, Homo sapiens
atggacccacagaactattccttggtgtcagaatttgtgttgcatggactctgcacttcacgacatcttcaaaattttttctttatatttttctttggggtctatgtggccattatgctgggtaaccttctcattttggtcactgtaatttctgatccctgcctgcactcctcccctatgtacttcctgctggggaacctagctttcctggacatgtggctggcctcatttgccactcccaagatgatcagggatttccttagtgatcaaaaactcatctcctttggaggatgtatggctcaaatcttcttcttgcactttactggtggggctgagatggtgctcctggtttccatggcctatgacagatatgtggccatatgcaaacccttgcattacatgactttgatgagttggcagacttgcatcaggctggtgctggcttcatgggtcgttggatttgtgcactccatcagtcaagtggctttcactgtaaatttgccttactgtggccccaatgaggtagacagcttcttctgtgacctccctctggtgatcaaacttgcctgcatggacacctatgtcttgggtataattatgatctcagacagtgggttgctttccttgagctgttttctgctcctcctgatctcctacaccgtgatcctcctcgctatcagacagcgtgctgccggtagcacatccaaagcactctccacttgctctgcacatatcatggtagtgacgctgttctttggcccttgcatttttgtttatgtgcggcctttcagtaggttctctgtggacaagctgctgtctgtgttttataccatttttactccactcctgaaccccattatctacacattgagaaatgaggagatgaaagcagctatgaagaaactgcaaaaccgacgggtgacttttcaatga

SEQ ID NO: 449 - protein, 313 aa, Homo sapiens
MAGENHTTLPEFLLLGFSDLKALQGPLFWVVLLVYLVTLLGNSLIILLTQVSPALHSPMYFFLRQLSVVELFYTTDIVPRTLANLGSPHPQAISFQGCAAQMYVFIVLGISECCLLTAMAYDRYVAICQPLRYSTLLSPRACLAMVGSSWLTGIITATTHASLIFSLPFRSHPIIPHFLCDILPVLRLASAGKHRSEISVMTATIVFIMIPFSLIVTSYIRILGAILAMASTQSRRKVFSTCSSHLLVVSLFFGTASITYIRPQAGSSVTTDRVLSLFYTVITPMLNPIIYTLRNKDVRRALRHLVKRQRPSP

SEQ ID NO: 450 - DNA, 942 bp, Homo sapiens
atggctggggaaaaccatactacactgcctgaattcctccttctgggattctctgacctcaaggccctgcagggccccctgttctgggtggtgcttctggtctacctggtcaccttgctgggtaactccctgatcatcctcctcacacaggtcagccctgccctgcactcccccatgtacttcttcctgcgccaactctcagtggtggagctcttctacaccactgacatcgtgcccaggaccctggccaatctgggctccccgcatccccaggccatctctttccagggctgtgcagcccagatgtacgtcttcattgtcctgggcatctcggagtgctgcctgctcacggccatggcctatgaccgatatgttgccatctgccagcccctacgctattccaccctcttgagcccacgggcctgcttggccatggtggggtcctcctggctcacaggcatcatcacggccaccacccatgcctccctcatcttctctctaccttttcgcagccacccgatcatcccgcactttctctgtgacatcctgccagtactgaggctggcaagtgctgggaagcacaggagcgagatctccgtgatgacagccaccatagtcttcattatgatccccttctctctgattgtcacctcttacatccgcatcctgggtgccatcctagcaatggcctccacccagagccgccgcaaggtcttctccacctgctcctcccatctgctcgtggtctctctcttctttggaacagccagcatcacctacatccggccgcaggcaggctcctctgttaccacagaccgcgtcctcagtctcttctacacagtcatcacacccatgctcaaccccatcatctacacccttcggaacaaggacgtgaggagggccctgcgacacttggtgaagaggcagcgcccctcaccctga

SEQ ID NO: 451 - protein, 335 aa, Homo sapiens
MPQILIFTYLNMFYFFPPLQILAENLTMVTEFLLLGFSSLGEIQLALFVVFLFLYLVILSGNVTIISVIHLDKSLHTPMYFFLGILSTSETFYTFVILPKMLINLLSVARTISFNCCALQMFFFLGFAITNCLLLGVMGYDRYAAICHPLHYPTLMSWQVCGKLAAACAIGGFLASLTVVNLVFSLPFCSANKVNHYFCDISAVILLACTNTDVNEFVIFICGVLVLVVPFLFICVSYLCILRTILKIPSAEGRRKAFSTCASHLSVVIVHYGCASFIYLRPTANYVSNKDRLVTVTYTIVTPLLNPMVYSLRNKDVQLAIRKVLGKKGSLKLYN

SEQ ID NO: 452 - DNA, 1008 bp, Homo sapiens
atgccccaaattcttatattcacatacctgaatatgttttacttctttccccctttgcagatcttggcagaaaacctcaccatggtcaccgaattcctgttgctgggtttttccagccttggtgaaattcagctggccctctttgtagtttttctttttctgtatctagtcattcttagtggcaatgtcaccattatcagtgtcatccacctggataaaagcctccacacaccaatgtacttcttccttggcattctctcaacatctgagaccttctacacctttgtcattctacccaagatgctcatcaatctactttctgtggccaggacaatctccttcaactgttgtgctcttcaaatgttcttcttccttggttttgccattaccaactgcctgctattgggtgtgatgggttatgatcgctatgctgccatttgtcaccctctgcattaccccactcttatgagctggcaggtgtgtggaaaactggcagctgcctgtgcaattggtggcttcttggcctctcttacagtagtaaatttagttttcagcctccctttttgtagcgccaacaaagtcaatcattacttctgtgacatctcagcagtcattcttctggcttgtaccaacacagatgttaacgaatttgtgatattcatttgtggagttcttgtacttgtggttccctttctgtttatctgtgtttcttatctctgcattctgaggactatcctgaagattccctcagctgagggcagacggaaagcgttttccacctgcgcctctcacctcagtgttgttattgttcattatggctgtgcttccttcatctacctgaggcctacagcaaactatgtgtccaacaaagacaggctggtgacggtgacatacacgattgtcactccattactaaaccccatggtttatagcctcagaaacaaggatgtccaacttgctatcagaaaagtgttgggcaagaaaggttctctaaaactatataattga

SEQ ID NO: 453 - protein, 308 aa, Homo sapiens
MNTTLFHPYSFLLLGIPGLESMHLWVGFPFFAVFLTAVLGNITILFVIQTDSSLHHPMFYFLAILSSIDPGLSTSTIPKMLGTFWFTLREISFEGCLTQMFFIHLCTGMESAVLVAMAYDCYVAICDPLCYTLVLTNKVVSVMALAIFLRPLVFVIPFVLFILRLPFCGHQIIPHTYGEHMGIARLSCASIRVNIIYGLCAISILVFDIIAIVISYVQILCAVFLLSSHDARLKAFSTCGSHVCVMLTFYMPAFFSFMTHRFGRNIPHFIHILLANFYVVIPPALNSVIYGVRTKQIRAQVLKMFFNK

SEQ ID NO: 454 - DNA, 927 bp, Homo sapiens
atgaataccactctatttcatccttactctttccttcttctgggaattcctgggctggaaagtatgcatctctgggttggttttcctttctttgctgtgttcctgacagctgtccttgggaatatcaccatcctttttgtgattcagactgacagtagtctccatcatcccatgttctacttcctggccattctgtcatctattgacccgggcctgtctacatccaccatccctaaaatgcttggcaccttctggtttaccctgagagaaatctcctttgaaggatgccttacccagatgttcttcatccacctgtgcactggcatggaatcagctgtgcttgtggccatggcctatgattgctatgtggccatctgtgaccctctttgctacacgttggtgctgacaaacaaggtggtgtcagttatggcactggccatctttctgagacccttagtctttgtcataccctttgttctatttatcctaaggcttccattttgtggacaccaaattattcctcatacttatggtgagcacatgggcattgcccgcctgtcttgtgccagcatcagggttaacatcatctatggcttatgtgccatctctatcctggtctttgacatcatagcaattgtcatttcctatgtacagatcctttgtgctgtatttctactctcttcacatgatgcacgactcaaggcattcagcacctgtggctctcatgtgtgtgtcatgttgactttctatatgcctgcatttttctcattcatgacccataggtttggtcggaatatacctcactttatccacattcttctggctaatttctatgtagtcattccacctgctctcaactctgtaatttatggtgtcagaaccaaacagattagagcacaagtgctgaaaatgtttttcaataaataa

SEQ ID NO: 455 - protein, 313 aa, Homo sapiens
MEQVNKTVVREFVVLGFSSLARLQQLLFVIFLLLYLFTLGTNAIIISTIVLDRALHTPMYFFLAILSCSEICYTFVIVPKMLVDLLSQKKTISFLGCAIQMFSFLFFGSSHSFLLAAMGYDRYMAICNPLRYSVLMGHGVCMGLMAAACACGFTVSLVTTSLVFHLPFHSSNQLHHFFCDISPVLKLASQHSGFSQLVIFMLGVFALVIPLLLILVSYIRIISAILKIPSSVGRYKTFSTCASHLIVVTVHYSCASFIYLRPKTNYTSSQDTLISVSYTILTPLFNPMIYSLRNKEFKSALRRTIGQTFYPLS

SEQ ID NO: 456 - DNA, 942 bp, Homo sapiens
atggagcaagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactcccatgtacttcttccttgccatcctttcttgctctgagatttgctatacctttgtcattgtacccaagatgctggttgacctgctgtcccagaagaagaccatttctttcctgggctgtgccatccaaatgttttccttcctcttctttggctcctctcactccttcctgctggcagccatgggctatgatcgctatatggccatctgtaacccactgcgctactcagtgctcatgggacatggggtgtgtatgggactaatggctgctgcctgtgcctgtggcttcactgtctccctggtcaccacctccctagtatttcatctgcccttccactcctccaaccagctccatcacttcttctgtgacatctcccctgtccttaaactggcatctcagcactccggcttcagtcagctggtcatattcatgcttggtgtatttgccttggtcattcctctgctacttatcctagtctcctacatccgcatcatctctgccattctaaaaatcccttcctccgttggaagatacaagaccttctccacctgtgcctcccatctcattgtggtaactgttcactacagttgtgcctctttcatctacttaaggcccaagactaattacacttcaagccaagacaccctaatatctgtgtcatacaccatccttaccccattgttcaatccaatgatttatagtctgagaaataaggaattcaaatcagccctacgaagaacaatcggccaaactttctatcctcttagttaa

SEQ ID NO: 457 - protein, 369 aa, Homo sapiens
MWQEYYFLNVFFPLLKVCCLTINSHVVILLPWECYHLIWKILPYIGTTVGSMEEYNTSSTDFTFMGLFNRKETSGLIFAIISIIFFTALMANGVMIFLIQTDLRLHTPMYFLLSHLSLIDMMYISTIVPKMLVNYLLDQRTISFVGCTAQHFLYLTLVGAEFFLLGLMAYDRYVAICNPLRYPVLMSRRVCWMIIAGSWFGGSLDGFLLTPITMSFPFCNSREINHFFCEAPAVLKLACADTALYETVMYVCCVLMLLIPFSVVLASYARILTTVQCMSSVEGRKKAFATCSSHMTVVSLFYGAAMYTYMLPHSYHKPAQDKVLSVFYTILTPMLNPLIYSLRNKDVTGALKRALGRFKGPQRVSGGVF

SEQ ID NO: 458 - DNA, 1110 bp, Homo sapiens
atgtggcaagaatactattttttaaatgttttcttcccacttttaaaagtttgctgcctaacaattaattcacatgttgttattttactgccctgggaatgctatcatcttatttggaagatattaccttatatcggcacaactgtaggatcaatggaagagtacaacacatcctctacagacttcactttcatggggctgttcaacagaaaggaaacctcaggtcttatttttgccatcatctctatcatcttcttcaccgcactgatggccaatggggttatgatcttcctgatccaaacagatttgcgccttcatacacccatgtacttcctcctcagccacctttccttaattgacatgatgtatatttccactattgtgcctaagatgctggttaattacctgctggatcaaaggaccatttcctttgtggggtgcacagctcaacacttcctctaccttacccttgtgggagctgaattcttcctgctgggcctcatggcctatgaccgctatgtggccatttgcaaccctctgagataccctgtcctcatgagccgccgggtctgttggatgattatagcaggttcctggtttgggggctctttggatggcttcctcctaacccccatcaccatgagctttcccttctgcaattcccgggagattaaccacttcttctgtgaggcaccagcagtcctgaagttggcatgtgcagacacagccctctacgagacagtgatgtatgtgtgctgtgttttgatgctgctgattcctttctctgtagtccttgcttcctatgcccgaatcctgactacagttcagtgcatgagctcagtggagggcaggaagaaggcatttgccacttgctcatcccacatgactgtggtgtccttgttctacggggctgccatgtacacctacatgctgccacattcttaccacaagccagcccaggacaaagtcctctctgtgttttacaccattctcacacccatgctgaaccccctcatctacagccttagaaacaaggatgtgactggagctctgaagagggccttggggaggttcaagggtcctcaaagggtgtcaggaggtgtcttttga

SEQ ID NO: 459 - protein, 312 aa, Homo sapiens
MDLKNGSLVTEFILLGFFGRWELQIFFFVTFSLIYGATVMGNILIMVTVTCRSTLHSPLYFLLGNLSFLDMCLSTATTPKMIIDLLTDHKTISVWGCVTQMFFMHFFGGAEMTLLIIMAFDRYVAICKPLHYRTIMSHKLLKGFAILSWIIGFLHSISQIVLTMNLPFCGHNVINNIFCDLPLVIKLACIETYTLELFVIADSGLLSFTCFILLLVSYIVILVSVPKKSSHGLSKALSTLSAHIIVVTLFFGPCIFIYVWPFSSLASNKTLAVFYTVITPLLNPSIYTLRNKKMQEAIRKLRFQYVSSAQNF

SEQ ID NO: 460 - DNA, 939 bp, Homo sapiens
atggatcttaaaaatggatctctagtgaccgagtttattttactaggattttttggacgatgggaacttcaaattttcttctttgtgacattttccctgatctacggtgctactgtgatgggaaacattctcattatggtcacagtgacatgtaggtcaacccttcattctcccttgtactttctccttggaaatctctcttttttggacatgtgtctctccactgccacaacacccaagatgatcatagatttgctcactgaccacaagaccatctctgtgtggggctgcgtgacccagatgttcttcatgcacttctttgggggtgctgagatgactcttctgataatcatggcctttgacaggtatgtagccatatgtaaacccctgcactataggacaatcatgagccacaagctgctaaaggggtttgcgatactttcatggataattggttttttacactccataagccagatagttttaacaatgaacttgcctttctgtggccacaatgtcataaacaacatattttgtgatcttccccttgtgatcaagcttgcttgcattgaaacatacaccctggaattatttgtcattgctgacagcgggctgctctctttcacctgtttcatcctcttgcttgtttcttacattgtcatcctggtcagtgtaccaaaaaaatcatcacatgggctctccaaggcgctgtccacattgtctgcccacatcattgtggtcactctgttctttggaccttgtatttttatctatgtttggccattcagtagtttggcaagcaataaaactcttgccgtattttatacagttatcacacccttactgaatccgagtatttataccctgagaaataagaaaatgcaagaggccataagaaaattacggttccaatatgttagttctgcacagaatttctag

SEQ ID NO: 461 - protein, 313 aa, Homo sapiens
MSPENQSSVSEFLLLGLPIRPEQQAVFFTLFLGMYLTTVLGNLLIMLLIQLDSHLHTPMYFFLSHLALTDISFSSVTVPKMLMDMRTKYKSILYEECISQMYFFIFFTDLDSFLITSMAYDRYVAICHPLHYTVIMREELCVFLVAVSWILSCASSLSHTLLLTRLSFCAANTIPHVFCDLAALLKLSCSDIFLNELVMFTVGVVVITLPFMCILVSYGYIGATILRVPSTKGIHKALSTCGSHLSVVSLYYGSIFGQYLFPTVSSSIDKDVIVALMYTVVTPMLNPFIYSLRNRDMKEALGKLFSRATFFSW

SEQ ID NO: 462 - DNA, 966 bp, Homo sapiens
atgagccctgagaaccagagcagcgtgtccgagttcctccttctgggcctccccatccggccagagcagcaggctgtgttcttcaccctgttcctgggcatgtacctgaccacggtgctggggaacctgctcatcatgctgctcatccagctggactctcaccttcacacccccatgtacttcttcctcagccacttggctctcactgacatctccttttcatctgtcactgtccctaagatgctgatggacatgcggactaagtacaaatcgatcctctatgaggaatgcatttctcagatgtatttttttatattttttactgacctggacagcttccttattacatcaatggcatatgaccgatatgttgccatatgtcaccctctccactacactgtcatcatgagggaagagctctgtgtcttcttagtggctgtatcttggattctgtcttgtgccagctccctctctcacacccttctcctgacccggctgtctttctgtgctgcgaacaccatcccccatgtcttctgtgaccttgctgccctgctcaagctgtcctgctcagatatcttcctcaatgagctggtcatgttcacagtaggggtggtggtcattaccctgccattcatgtgtatcctggtatcatatggctacattggggccaccatcctgagggtcccttcaaccaaagggatccacaaagcattgtccacatgtggctcccatctctctgtggtgtctctctattatgggtcaatatttggccagtaccttttcccgactgtaagcagttctattgacaaggatgtcattgtggctctcatgtacacggtggtcacacccatgttgaacccctttatctacagccttaggaacagggacatgaaagargcccttgggaaactcttcagtagagcaacatttttctccttggtgacatctgactttttaaaaaattag

SEQ ID NO: 463 - protein, 307 aa, Homo sapiens
MGQHNLTVLTEFILMELTRRPELQIPLFGVFLVIYLITVVGNLTMIILTKLDSHLHTPMYFSIRHLASVDLGNSTVICPKVLANFVVDRNTISYYACAAQLAFFLMFIISEFFILSAMAYDRYVAICNPLLYYVIMSQRLCHVLVGIQYLYSTFQALMFTIKIFTLTFCGSNVISHFYCDDVPLLPMLCSNAQEIELLSILFSVFNLISSFLIVLVSYMLILLAICQMHSAEGRKKAFSTCGSHLTVVVVFYGSLLFMYMQPNSTHFFDTDKMASVFYTLVIPMLNPLIYSLRNEEVKNAFYKLFEN

SEQ ID NO: 464 - DNA, 924 bp, Homo sapiens
atgggccaacacaatctaacagtgctaactgaattcattctgatggaactcacaaggcggcctgagctgcagattcccctttttggagtcttcctcgtcatctacctaatcacagtggtgggcaacctaactatgatcattttgaccaaactggactcccacttacatacacctatgtacttttctatcagacatttggcttctgttgatcttggtaattctactgtcatttgtcccaaggtgctggcaaattttgttgtggatcgaaatactatttcctattatgcatgtgctgcacagctggcattcttccttatgttcattatcagtgaatttttcatcctgtcagccatggcctatgaccgctatgtggccatttgtaaccctctgctctattatgttattatgtctcagcgactgtgtcatgtactggtgggcattcaatatctctacagcacatttcaggctctgatgttcactattaagatttttacattgaccttctgtggctctaatgtcatcagtcatttttactgtgatgatgttcctttgctacctatgctttgctcaaatgcacaggaaatagaattgttgagcatactattttctgtatttaatttgatctcctcctttctgatagtcttagtgtcctacatgttgattttgttagctatatgtcaaatgcattctgcagagggcaggaaaaaggctttctccacatgtggttcccatttgacagtggtggttgtgttctatgggtctctactcttcatgtacatgcagcccaattccactcacttctttgatactgataaaatggcttctgtgttttacactttagtaatccccatgcttaaccctttgatttacagcttaagaaacgaagaggtgaaaaatgccttctataagctctttgagaattga

SEQ ID NO: 465 - protein, 340 aa, Homo sapiens
MPCMPCALPTGGLLPHPQHTMMEIANVSSPEVFVLLGFSTRPSLETVLFIVVLSFYMVSILGNGIIILVSHTDVHLHTPMYFFLANLPFLDMSFTTSIVPQLLANLWGPQKTISYGGCVVQFYISHWLGATECVLLATMSYDRYAAICRPLHYTVIMHPQLCLGLALASWLGGLTTSMVGSTLTMLLPLCGNNCIDHFFCEMPLIMQLACVDTSLNEMEMYLASFVFVVLPLGLILVSYGHIARAVLKIRSAEGRRKAFNTCSSHVAVVSLFYGSIIFMYLQPAKSTSHEQGKFIALFYTVVTPALNPLIYTLRNTEVKSALRHMVLENCCGSAGKLAQI

SEQ ID NO: 466 - DNA, 1023 bp, Homo sapiens
atgccctgtatgccctgtgctcttcccacaggtggccttttgccccacccccagcatacaatgatggaaatagccaatgtgagttctccagaagtctttgtcctcctgggcttctccacacgaccctcactagaaactgtcctcttcatagttgtcttgagtttttacatggtatcgatcttgggcaatggcatcatcattctggtctcccatacagatgtgcacctccacacacctatgtacttctttcttgccaacctccccttcctggacatgagcttcaccacgagcattgtcccacagctcctggctaacctctggggaccacagaaaaccataagctatggagggtgtgtggtccagttctatatctcccattggctgggggcaaccgagtgtgtcctgctggccaccatgtcctatgaccgctacgctgccatctgcaggccactccattacactgtcattatgcatccacagctttgccttgggctagctttggcctcctggctggggggtctgaccaccagcatggtgggctccacgctcaccatgctcctaccgctgtgtgggaacaattgcatcgaccacttcttttgcgagatgcccctcattatgcaactggcttgtgtggataccagcctcaatgagatggagatgtacctggccagctttgtctttgttgtcctgcctctggggctcatcctggtctcttacggccacattgcccgggccgtgttgaagatcaggtcagcagaagggcggagaaaggcattcaacacctgttcttcccacgtggctgtggtgtctctgttttacgggagcatcatcttcatgtatctccagccagccaagagcacctcccatgagcagggcaagttcatagctctgttctacaccgtagtcactcctgcgctgaacccacttatttacaccctgaggaacacggaggtgaagagcgccctccggcacatggtattagagaactgctgtggctctgcaggcaagctggcgcaaatttag

SEQ ID NO: 467 - protein, 338 aa, Homo sapiens
MKSQIEKSDLKYRAILLQKVTRMFLLFWVLLLVLSRLLVVMGRGNSTEVTEFHLLGFGVQHEFQHVLFIVLLLIYVTSLIGNIGMILLIKTDSRLQTPMYFFPQHLAFVDICYTSAITPKMLQSFTEENNLITFRGCVIQFLVYATFATSDCYLLAIMAMDCYVAICKPLRYPMIMSQTVYIQLVAGSYIIGSINASVHTGFTFSLSFCKSNKINHFFCDGLPILALSCSNIDINIILDVVFVGFDLMFTELVIIFSYIYIMVTILKMSSTAGRKKSFSTCASHLTAVTIFYGTLSYMYLQPQSNNSQENMKVASIFYGTVIPMLNPLIYSLRNKEGK

SEQ ID NO: 468 - DNA, 1017 bp, Homo sapiens
atgaaaagtcaaattgaaaaaagtgacttaaaatatagagccattttattgcaaaaagtcacaaggatgttcctgcttttctgggtccttctcttggtcctttctagacttttggtagtcatgggtcgaggaaacagcactgaagtgactgaattccatcttctgggatttggtgtccaacacgaatttcagcatgtccttttcattgtacttcttcttatctatgtgacctccctgataggaaatattggaatgatcttactcatcaagaccgattccagacttcaaacacccatgtacttttttccacaacatttggcttttgttgatatctgttatacttctgctatcactcccaagatgctccaaagcttcacagaagaaaataatttgataacatttcggggctgtgtgatacaattcttagtttatgcaacatttgcaaccagtgactgttacctcctagctattatggcaatggattgttatgttgccatctgtaagccccttcgctatcccatgatcatgtcccaaacagtctacatccaactcgtagctggctcatatattataggctcaataaatgcctctgtacatacaggttttacattttcactgtccttctgcaagtctaataaaatcaatcactttttctgtgatggtctcccaattcttgccctttcatgctccaacattgacatcaacatcattctagatgttgtctttgtgggatttgacttgatgttcactgagttggtcatcatcttttcctacatctacattatggtcaccatcctgaagatgtcttctactgctgggaggaaaaaatccttctccacatgtgcctcccacctgacagcagtaaccattttctatgggacactctcttacatgtacttacagcctcagtctaataattctcaggagaatatgaaagtagcctctatattttatggcactgttattcccatgttgaatcctttaatctatagcttgagaaataaggaaggaaaataa

SEQ ID NO: 469 - protein, 311 aa, Homo sapiens
MENQSSISEFFLRGISAPPEQQQSLFGIFLCMYLVTLTGNLLIILAIGSDLHLHTPMYFFLANLSFVDMGLTSSTVTKMLVNIQTRHHTISYTGCLTQMYFFLMFGDLDSFFLAAMAYDRYVAICHPLCYSTVMRPQVCALMLALCWVLTNIVALTHTFLMARLSFCVTGEIAHFFCDITPVLKLSCSDTHINEMMVFVLGGTVLIVPFLCIVTSYIHIVPAILRVRTRGGVGKAFSTCSSHLCVVCVFYGTLFSAYLCPPSIASEEKDIAAAAMYTIVTPMLNPFIYSLRNKDMKGALKRLFSHRSIVSS

SEQ ID NO: 470 - DNA, 936 bp, Homo sapiens
atggaaaaccaatccagcatttctgaatttttcctccgaggaatatcagcgcctccagagcaacagcagtccctcttcggaattttcctgtgtatgtatcttgtcaccttgactgggaacctgctcatcatcctggccattggctctgacctgcacctccacacccccatgtactttttcttggccaacctgtcttttgttgacatgggtttaacgtcctccacagttaccaagatgctggtgaatatacagactcggcatcacaccatctcctatacgggttgcctcacgcaaatgtatttctttctgatgtttggtgatctagacagcttcttcctggctgccatggcgtatgaccgctatgtggccatttgccaccccctctgctactccacagtcatgaggccccaagtctgtgccctaatgcttgcattgtgctgggtcctcaccaatatcgttgccctgactcacacgttcctcatggctcggttgtccttctgtgtgactggggaaattgctcactttttctgtgacatcactcctgtcctgaagctgtcatgttctgacacccacatcaacgagatgatggtttttgtcttgggaggcaccgtactcatcgtcccctttttatgcattgtcacctcctacatccacattgtgccagctatcctgagggtccgaacccgtggtggggtgggcaaggccttttccacctgcagttcccacctctgcgttgtttgtgtgttctatgggaccctcttcagtgcctacctgtgtcctccctccattgcctctgaagagaaggacattgcagcagctgcaatgtacaccatagtgactcccatgttgaacccctttatctatagcctaaggaacaaggacatgaagggggccctaaagaggctcttcagtcacaggagtattgtttcctcttag

SEQ ID NO: 471 - protein, 309 aa, Homo sapiens
MEGNKTWITDITLPRFQVGPALEILLCGLFSAFYTLTLLGNGVIFGIICLDCKLHTPMYFFLSHLAIVDISYASNYVPKMLTNLMNQESTISFFPCIMQTFLYLAFAHVECLILVVMSYDRYADICHPLRYNILMSWRVCTVLAVASWVFSFLLALVPLVLILRLPFCGPHEINHFCEILSVLKLACADTWLNQVVIFAACVFILVGPLCLVLVSYLRILAAILRIQSGEGRRKAFSTCSSHLCVVGLFFGSAIVTYMAPKSRHPEEQQKVLSLFYSLFNPMLNPLIYSLRNAEVKGALRRALRKERLT

SEQ ID NO: 472 - DNA, 930 bp, Homo sapiens
atggaaggcaacaagacatggatcacagacatcaccttgccgcgattccaggttggtccagcactggagattctcctctgtggacttttctctgccttctatacactcaccctgctggggaatggggtcatctttgggattatctgcctggactgtaagcttcacacacccatgtacttcttcctctcacacctggccattgttgacatatcctatgcttccaactatgtccccaagatgctgacgaatcttatgaaccaggaaagcaccatctccttttttccatgcataatgcagacattcttgtatttggcttttgctcacgtagagtgtctgattttggtggtgatgtcctatgatcgctatgcggacatctgccaccccttacgttacaatatcctcatgagctggagagtgtgcactgtcctggctgtggcttcctgggtgttcagcttcctcctggctctggtccctttagttctcatcctgaggctgcccttctgcgggcctcatgaaatcaaccacttctgtgaaatcctgtctgtcctcaagttggcctgtgctgacacctggctcaaccaggtggtcatctttgcagcctgcgtgttcatcctggtggggccactctgcctggtgctggtctcctacttgcgcatcctggccgccatcttgaggatccagtctggggagggccgcagaaaggccttctccacctgctcctcccacctttgcgtggtgggactcttctttggcagcgccattgtcacgtacatggcccccaagtcccgccatcctgaggagcagcagaaagttctttccctgttttacagccttttcaatccaatgctgaaccccctgatatatagcctaaggaatgcagaggtcaagggcgccctgaggagggcactgaggaaggagaggctgacgtga

SEQ ID NO: 473 - protein, 312 aa, Homo sapiens
MRLANQTLGGDFFLLGIFSQISHPGRLCLLIFSIFLMAVSWNITLILLIHIDSSLHTPMYFFINQLSLIDLTYISVTVPKMLVNQLAKDKTISVLGCGTQMYFYLQLGGAECCLLAAMAYDRYVAICHPLRYSVLMSHRVCLLLASGCWFVGSVDGFMLTPIAMSFPFCRSHEIQHFFCEVPAVLKLSCSDTSLYKIFMYLCCVIMLLIPVTVISVSYYYIILTIHKMNSVEGRKKAFTTCSSHITVVSLFYGAAIYNYMLPSSYQTPEKDMMSSFFYTILTPVLNPIIYSFRNKDVTRALKKMLSVQKPPY

SEQ ID NO: 474 - DNA, 939 bp, Homo sapiens
atgcggctggccaaccagaccctgggtggtgactttttcctgttgggaatcttcagccagatctcacaccctggccgcctctgcttgcttatcttcagtatatttttgatggctgtgtcttggaatattacattgatacttctgatccacattgactcctctctgcatactcccatgtacttctttataaaccagctctcactcatagacttgacatatatttctgtcactgtccccaaaatgctggtgaaccagctggccaaagacaagaccatctcggtccttgggtgtggcacccagatgtacttctacctgcagttgggaggtgcagagtgctgccttctagccgccatggcctatgaccgctatgtggctatctgccatcctctccgttactctgtgctcatgagccatagggtatgtctcctcctggcatcaggctgctggtttgtgggctcagtggatggcttcatgctcactcccatcgccatgagcttccccttctgcagatcccatgagattcagcacttcttctgtgaggtccctgctgttttgaagctctcttgctcagacacctcactttacaagattttcatgtacttgtgctgtgtcatcatgctcctgatacctgtgacggtcatttcagtgtcttactactatatcatcctcaccatccataagatgaactcagttgagggtcggaaaaaggccttcaccacctgctcctcccacattacagtggtcagcctcttctatggagctgctatttacaactacatgctccccagctcctaccaaactcctgagaaagatatgatgtcatcctttttctacactatccttacacctgtcttgaatcctatcatttacagtttcaggaataaggatgtcacaagggctttgaaaaaaatgctgagcgtgcagaaacctccatattaa

SEQ ID NO: 475 - protein, 331 aa, Homo sapiens
MTFFSSGGNCEPVMCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFHLTLAGAEVFLLAAMAYDRYAAVCRPLHYPLLMNQRVCQLLVSACWVLGMVDGLLLTPITMSFPFCQSRKILSFFCETPALLKLSCSDVSLYKMLTYLCCILMLLTPIMVISSSYTLILHLIHRMNSAAGRRKALATCSSHMIIVLLLFGASFYTYMLRSSYHTAEQDMMVSAFYTIFTPVLNPLIYSLRNKDVTRALRSMMQSRMNQEK

SEQ ID NO: 476 - DNA, 996 bp, Homo sapiens
atgacttttttttcctcagggggaaactgtgagccagtcatgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttccacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagatgctcacgtacctgtgctgcatcctcatgcttctcacccccatcatggtcatctccagctcatacaccctcatcctgcatctcatccacaggatgaattctgccgccggccgcaggaaggccttggccacctgctcctcccacatgatcatagtgctgctgctcttcggtgcttccttctacacctacatgctccggagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtag

SEQ ID NO: 477 - protein, 316 aa, Homo sapiens
MTNTSSSDFTLLGLLVNSEAAGIVFTVILAVFLGAVTANLVMIFLIQVDSRLHTPMYFLLSQLSIMDTLFICTTVPKLLADMVSKEKIISFVACGIQIFLYLTMIGSEFFLLGLMAYDCYVAVCNPLRYPVLMNRKKCLLLAAGAWFGGSLDGFLLTPITMNVPYCGSRSINHFFCEIPAVLKLACADTSLYETLMYICCVLMLLIPISIISTSYSLILLTIHRMPSAEGRKKAFTTCSSHLTVVSIFYGAAFYTYVLPQSFHTPEQDKVVSAFYTIVTPMLNPLIYSLRNKDVIGAFKKVFACCSSAQKVATSDA

SEQ ID NO: 478 - DNA, 951 bp, Homo sapiens
atgacgaacacatcatcctctgacttcaccctcctggggcttctggtgaacagtgaggctgccgggattgtatttacagtgatccttgctgttttcttgggggccgtgactgcaaatttggtcatgatattcttgattcaggtggactctcgcctccacacccccatgtactttctgctcagtcagctgtccatcatggacacccttttcatctgtaccactgtcccaaaactcctggcagacatggtttctaaagagaagatcatttcctttgtggcctgtggcatccagatcttcctctacctgaccatgattggttctgagttcttcctcctgggcctcatggcctatgactgctacgtggctgtctgtaaccctctgagatacccagtcctgatgaaccgcaagaagtgtcttttgctggctgctggtgcctggtttgggggctccctcgatggctttctgctcactcccatcaccatgaatgtcccttactgtggctcccgaagtatcaaccattttttctgtgagatcccagcagttctgaaactggcctgtgcagacacgtccttgtatgaaactctgatgtacatctgctgtgtcctcatgttgctcatccccatctctatcatctccacttcctactccctcatcttgttaaccatccaccgcatgccctctgctgaaggtcgcaaaaaggccttcaccacttgttcctcccacttgactgtagttagcatcttctatggggctgccttctacacatacgtgctgccccagtccttccacacccccgagcaggacaaagtagtgtcagccttctataccattgtcacgcccatgcttaatcctctcatctacagcctcagaaacaaggacgtcataggggcatttaaaaaggtatttgcatgttgctcatctgctcagaaagtagcaacaagtgatgcttag

SEQ ID NO: 479 - protein, 317 aa, Homo sapiens
MEQSNYSVYADFILLGLFSNARFPWLLFALILLVFLTSIASNVVKIILIHIDSRLHTPMYFLLSQLSLRDILYISTIVPKMLVDQVMSQRAISFAGCTAQHFLYLTLAGAEFFLLGLMSYDRYVAICNPLHYPVLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRGKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 480 - DNA, 954 bp, Homo sapiens
atggagcagagcaattattccgtgtatgccgactttatccttctgggtttgttcagcaacgcccgtttcccctggcttctctttgccctcattctcctggtctttttgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctatgatcgctacgtagccatctgcaaccctctgcactatcctgtcctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtcatctcgggctcttacacaagaattctcattactgtttataggatgagcgaggcagaggggaggggaaaggctgtggccacctgctcctcacacatggtggttgtcagcctcttctatggggctgccatgtacacatacgtgctgcctcattcttaccacacccctgagcaggacaaagctgtatctgccttctacaccatccttactcccatgctcaatccactcatttacagccttaggaacaaggatgtcacaggggccctacagaaggttgtggggaggtgtgtgtcctcaggaaaggtaaccactttctaa

SEQ ID NO: 481 - protein, 311 aa, Homo sapiens
MGGKQPWVTEFILVGFQVGPALAILLCGLFSVFYTLTLLGNGVIFGIICLDSKLHTPMYFFLSHLAIIDMSYASNNVPKMLANLMNQKSTISFVPCIMQTFLYLAFAVTECLILVVMSYDRYVAICHPFQYTVIMSWRVCTILASTCWIISFLMALVHITHILRPPFCGPQKINHFICQIMSVFKLACAGPRLNQVVLYAGSAFIVEGPLCLELVSNLHILSRHLEDPVMGRAADRLTLPAPSHLCMVGLLFGSTMVMYMAPKSRHPEEQQKVLSLFYSLFNPMLNPLIYSLRNAEVKGALKRVLWKQRSK

SEQ ID NO: 482 - DNA, 936 bp, Homo sapiens
atgggaggcaagcagccctgggtcacagaattcatcctggtgggattccaggttggtccagcactggcgattctcctctgtggactcttctctgtcttctatacactcaccctgctggggaatggggtcatctttgggattatctgcctggactctaagcttcacacacccatgtacttcttcctctcacacctggccatcattgacatgtcctatgcttccaacaatgttcccaagatgttggcaaacctaatgaaccagaaaagcaccatctcctttgttccatgcataatgcagacttttttgtatttggcttttgctgttacagagtgcctgattttggtggtgatgtcctatgataggtatgtggccatctgccaccctttccagtacactgtcatcatgagctggagagtgtgcacgatcctggcctcaacatgctggataattagctttctcatggctctggtccatataactcatattctgaggccgcctttttgtggcccacaaaagatcaaccactttatctgtcaaatcatgtccgtattcaaattggcctgtgctggccctaggctcaaccaggtggtcctatatgcgggttctgcgttcatcgtagaggggccgctctgcctggagctggtctccaacttgcacatcctgtcgcgccatcttgaggatccagtaatggggagggccgcagaccgacttactcttcctgctccttcccacctttgcatggtgggactcctttttggcagcaccatggtcatgtacatggcccccaagtcccgccaccctgaggagcagcagaaggtcctttccctgttttacagccttttcaacccgatgctgaaccccttgatctacagcctgaggaacgcagaggtcaagggtgccctgaaaagagtgttgtggaaacagagatcaaagtga

SEQ ID NO: 483 - protein, 310 aa, Homo sapiens
MESNQTWITEVILLGFQVDPALELFLFGFFLLFYSLTLMGNGIILGLIYLDSRLHTPMYVFLSHLAIVDMSYASSTVPKMLANLVMHKKVISFAPCILQTFLYLAFAITECLILVMMCYDRYVAICHPLQYTLIMNWRVCTVLASTCWIFSFLLALVHITLILRLPFCGPQKINHFFCQIMSVFKLACADTRLNQVVLFAGSAFILVGPLCLVLVSYLHILVAILRIQSGEGRRKAFSTCSSHLCVVGLFFGSAIVMYMAPKSSHSQERRKILSLFYSLFNPILNPLIYSLRNAEVKGALKRVLWKQRSM

SEQ ID NO: 484 - DNA, 933 bp, Homo sapiens
atggaaagcaatcagacctggatcacagaagtcatcctgttgggattccaggtggacccagctctggagttgttcctctttgggtttttcttgctattctacagcttaaccctgatgggaaatgggattatcctggggctcatctacttggactctagactgcacacacccatgtatgtcttcctgtcacacctggccattgtggacatgtcctatgcctcgagtactgtccctaagatgctagcaaatcttgtgatgcacaaaaaagtcatctcctttgctccttgcatacttcagacttttttgtatttggcgtttgctattacagagtgtctgattttggtgatgatgtgctatgatcggtatgtggcaatctgtcaccccttgcaatacaccctcattatgaactggagagtgtgcactgtcctggcctcaacttgctggatatttagctttctcttggctctggtccatattactcttattctgaggctgcctttttgtggcccacaaaagatcaaccactttttctgtcaaatcatgtccgtattcaaattggcctgtgctgacactaggctcaaccaggtggtcctatttgcgggttctgcgttcatcttagtggggccgctctgcctggtgctggtctcctacttgcacatcctggtggccatcttgaggatccagtctggggagggccgcagaaaggccttctctacctgctcctcccacctctgcgtggtggggcttttctttggcagcgccattgtcatgtacatggcccccaagtcaagccattctcaagaacggaggaagatcctttccctgttttacagccttttcaacccgatcctgaaccccctcatctacagccttaggaatgcagaggtgaaaggggctctaaagagagtcctttggaaacagagatcaatgtga

SEQ ID NO: 485 - protein, 310 aa, Homo sapiens
MGDNQSRVTEFILVGFQLSVEMEVLLFWIFSLLYLFSLLANGMILGLICLDPRLRTPMYFFLSHLAVIDIYYASSNLLNMLENLVKHKKTISFISCIMQMALYLTFAAAVCMILVVMSYDRFVAICHPLHYTVIMNWRVCTVLAITSWACGFSLALINLILLLRLPFCGPQEVNHFFGEILSVLKLACADTWINEIFVFAGGVFVLVGPLSLMLISYMRILLAILKIQSKEGRKKAFSTCSSHLCVVGLYFGMAMVVYLVPDNSQRQKQQKILTLFYSLFNPLLNPLIYSLRNAQVKGALYRALQKKRTM

SEQ ID NO: 486 - DNA, 933 bp, Homo sapiens
atgggggacaaccaatcacgggtcacagaattcatcctggttggattccagctcagtgtggagatggaagtgctcctcttctggatcttctccctgttatatctcttcagcctgctggcaaatggcatgatcttggggctcatctgtctggatcccagactgcgcacccccatgtacttcttcctgtcacacttggccgtcattgacatatactatgcttccagcaatttgctcaacatgctggaaaacctagtgaaacacaaaaaaactatctcgttcatctcttgcattatgcagatggctttgtatttgacttttgctgctgcagtgtgcatgattttggtggtgatgtcctatgacagatttgtggcgatctgccatcccctgcattacactgtcatcatgaactggagagtgtgcacagtactggctattacttcctgggcatgtggattttccctggccctcataaatctaattctccttctaaggctgcccttctgtgggccccaggaggtgaaccacttcttcggtgaaattctgtctgtcctcaaactggcctgtgcagacacctggattaatgaaatttttgtctttgctggtggtgtgtttgtcttagtcgggcccctttccttgatgctgatctcctacatgcgcatcctcttggccatcctgaagatccagtcaaaggagggccgcaaaaaagccttttccacctgctcctcccacctctgtgtggttgggctttactttggcatggccatggtggtttacctggtcccagacaacagtcaacgacagaagcagcagaaaattctcaccctgttttacagccttttcaacccattgctgaaccccctcatctacagcctgcggaatgctcaagtgaagggtgccttatacagagcactgcagaaaaagaggaccatgtga

SEQ ID NO: 487 - protein, 312 aa, Homo sapiens
MPSINDTHFYPPFFLLLGIPGLDTLHIWISFPFCIVYLIAIVGNMTILFVIKTEHSLHQPMFYFLAMLSMIDLGLSTSTIPKMLGIFWFNLQEISFGGCLLQMFFIHMFTGMETVLLVVMAYDRFVAICNPLQYTMILTNKTISILASVVVGRNLVLVTPFVFLILRLPFCGHNIVPHTYCEHRGLAGLACAPIKINIIYGLMVISYIIVDVILIASSYVLILRAVFRLPSQDVRLKAFNTCGSHVCVMLCFYTPAFFSFMTHRFGQNIPHYIHILLANLYVVVPPALNPVIYGVRTKQIREQIVKIFVQKE

SEQ ID NO: 488 - DNA, 939 bp, Homo sapiens
atgccttctatcaatgacacccacttctatccccccttcttcctcctgctaggaataccaggactggacactttacatatctggatttctttcccattctgtattgtgtacctgattgccattgtggggaatatgaccattctctttgtgatcaaaactgaacatagtctacaccagcccatgttctacttcctggccatgttgtctatgattgatctgggtctgtccacatccactatccccaaaatgctaggaatcttctggttcaacctccaagagatcagctttgggggatgccttcttcagatgttctttattcacatgtttacaggcatggagactgttctgttggtggtcatggcttatgaccgctttgttgccatctgcaaccctctccagtacaccatgatcctcaccaataaaaccatcagtatcctagcttctgtggttgttggaagaaatttagttcttgtaaccccatttgtgtttctcattctgcgtctgccattctgtgggcataacatcgtacctcacacatactgtgagcacaggggtctggccgggttggcctgtgcacccattaagatcaacataatctatgggctcatggtgatttcttatattattgtggatgtgatcttaattgcctcttcctatgtgcttatccttagagctgtttttcgccttccctctcaagatgtccgactaaaggccttcaatacctgtggttctcatgtctgtgttatgctgtgcttttacacaccagcatttttttcttttatgacacatcgttttggccaaaacattccccactatatccatattcttttggctaacctgtatgtggttgtcccacctgcccttaaccctgtcatttatggagtcaggaccaagcagatccgagagcaaattgtgaaaatatttgtacagaaagaataa

SEQ ID NO: 489 - protein, 327 aa, Homo sapiens
MLHTNNTQFHPSTFLVVGVPGLEDVHVWIGFPFFAVYLTALLGNIIILFVIQTEQSLHQPMFYFLAMLAGTDLGLSTATIPKMLGIFWFNLGEIAFGACITQMYTIHICTGLESVVLTVTGIDRYIAICNPLRYSMILTNKVIAILGIVIIVRTLVFVTPFTFLTLRLPFCGVRIIPHTYCEHMGLAKLACASINVIYGLIAFSVGYIDISVIGFSYVQILRAVFHLPAWDARLKALSTCGSHVCVMLAFYLPALFSFMTHRFGHNIPHYIHILLANLYVVFPPALNSVIYGVKTKQIREQVLRILNPKSFWHFDPKRIFHNNSVRQ

SEQ ID NO: 490 - DNA, 984 bp, Homo sapiens
atgcttcataccaacaatacacagtttcacccttccaccttcctcgtagtgggggtcccagggctggaagatgtgcatgtatggattggcttccccttctttgcggtgtatctaacagcccttctagggaacatcattatcctgtttgtgatacagactgaacagagcctccaccaacccatgttttacttcctagccatgttggccggcactgatctgggcttgtctacagcaaccatccccaagatgctgggaattttctggtttaatcttggagagattgcatttggtgcctgcatcacacagatgtataccattcatatatgcactggcctggagtctgtggtactgacagtcacgggcatagatcgctatattgccatctgcaaccccctgagatatagcatgatccttaccaacaaggtaatagccattctgggcatagtcatcattgtcaggactttggtatttgtgactccattcacatttctcaccctgagattgcctttctgtggtgtccggattatccctcatacctattgtgaacacatgggcttggcaaagttagcttgtgccagtattaatgttatatatggattgattgccttctcagtgggatacattgacatttctgtgattggattttcctatgtccagatcctccgagctgtcttccatctcccagcctgggatgcccggcttaaggcactcagcacatgtggctctcacgtctgtgttatgttggctttctacctgccagccctcttttccttcatgacacaccgctttggccacaacatccctcattacatccacattcttctggccaatctgtatgtggtttttccccctgctcttaactctgttatctatggggtcaaaacaaaacagatacgagagcaggtacttaggatactcaaccctaaaagcttttggcattttgaccccaagaggatcttccacaacaattcagttagacaataa

SEQ ID NO: 491 - protein, 309 aa, Homo sapiens
MKNKTVLTEFILLGLTDVPELQVAVFTFLFLAYLLSILGNLTILILTLLDSHLQTPMYFFLRNFSFLEISFTNIFIPRVLISITTGNKSISFAGCFTQYFFAMFLGATEFYLLAAMSYDRYVAICKPLHYTTIMSSRICIQLIFCSWLGGLMAIIPTITLMSQQDFCASNRLNHYFCDYEPLLELSCSDTSLIEKVVFLVASVTLVVTLVLVILSYAFIIKTILKLPSAQQRTKAFSTCSSHMIVISLSYGSCMFMYINPSAKEGDTFNKGVALLITSVAPLLNPFIYTLRNQQVKQPFKDMVKKLLNL

SEQ ID NO: 492 - DNA, 930 bp, Homo sapiens
atgaaaaataaaaccgtgttaactgagtttatccttctgggtctaacagatgtccctgaactccaggtggcagttttcacctttcttttccttgcgtatttactcagcatccttggaaatctgactatcctcatcctcaccttgctggactcccaccttcagactcccatgtatttctttctccggaacttctccttcttggaaatttccttcacaaacatcttcattccaagggtcctgattagcatcacaacagggaacaagagtatcagctttgctggctgcttcactcagtatttctttgccatgttccttggggctacagagttttaccttctggctgccatgtcctatgaccgctatgtggccatctgcaaacctctgcattacaccaccatcatgagcagcagaatctgcatccagctgattttctgctcttggctgggtgggctaatggctattataccaacaatcaccctgatgagtcagcaggacttttgtgcatccaacagactgaatcattacttctgtgactatgagcctcttctggaactctcatgttcagacacaagcctcatagagaaggttgtctttcttgtggcatctgtgaccctggtggtcactctggtgctagtgattctctcctatgcattcattatcaagactattctgaagctcccctctgcccaacaaaggacaaaagccttttccacatgttcttcccacatgattgtcatctccctctcttacggaagctgcatgtttatgtacattaatccctctgcaaaagaaggggatacattcaacaagggagtagctctactcattacttcagttgctcctttgttgaacccctttatttacaccctaaggaaccaacaggtaaaacaacccttcaaggatatggtcaaaaagcttctgaatctttaa

SEQ ID NO: 493 - protein, 317 aa, Homo sapiens
MEGKNQTAPSEFIILGFDHLNELQYLLFTIFFLTYICTLGGNVFIIVVTIADSHLHTPMYYFLGNLALIDICYTTTNVPQMMVHLLSEKKIISYGGCVTQLFAFIFFVGSECLLLAAMAYDRYIAICKPLRYSFIMNKALCSWLAASCWTCGFLNSVLHTVLTFHLPFCGNNQINYFFCDIPPLLILSCGDTSLNELALLSIGILISWTPFLCIILSYLYIISTILRIRSSEGRHKAFSTCASHLLIVILYYGSAIFTYVRPISSYSLEKDRLISVLYSVVTPMLNPVIYTLRNKDIKEAVKAIGRKWQPPVFSSDI

SEQ ID NO: 494 - DNA, 954 bp, Homo sapiens
atggaaggaaagaatcaaacagctccatctgaattcatcatcttggggttcgaccacctgaatgaattgcagtatttactcttcaccatcttctttctgacctacatatgcactttaggaggcaatgtttttatcattgtggtgaccatagctgattcccacctacacacacccatgtattatttcctaggaaatcttgcccttattgacatctgctacactactactaatgtcccccagatgatggtgcatcttctgtcagagaagaaaatcatttcctatggaggctgtgtgacccagctctttgcattcattttctttgttggctcagagtgtctcctcctggcagcaatggcatatgatcgatatattgctatctgtaagccgttaaggtactcatttattatgaacaaggccctgtgcagctggttagcagcctcatgctggacatgtgggtttctcaactcagtgttgcacaccgttctgaccttccacctgcccttctgtggtaacaatcagatcaattatttcttctgtgacatacctcccttgctcatcttgtcttgtggtgatacttccctcaatgaactggctttgctgtccattgggatcctcataagctggactcctttcctgtgcatcatcctttcctacctttacatcatctccaccatcctgaggatccgttcctctgaggggaggcacaaagccttttccacctgtgcctcccacctgctcattgttattctctattatggcagtgctatcttcacgtatgtgaggcccatctcatcttactctctagagaaagatagattgatctcagtgctgtatagtgttgtcacacccatgctgaatcctgtaatttatacgctaaggaataaggacatcaaagaggctgtgaaggccatagggagaaagtggcagccaccagttttctcttctgatatataa

SEQ ID NO: 495 - protein, 314 aa, Homo sapiens
MARKDMAHINCTQATEFILVGLTDHQELKMPLFVLFLSIYLFTVVGNLGLILLIRADTSLNTPMYFFLSNLAFVDFCYSSVITPKMLGNFLYKQNVISFDACATQLGCFLTFMISESLLLASMAYDRYVAICNPLLYMVVMTPGICIQLVAVPYSYSFLMALFHTILTFRLSYCHSNIVNHFYCDDMPLLRLTCSDTRFKQLWIFACAGIMFISSLLIVFVSYMFIISAILRMHSAEGRQKAFSTCGSHMLAVTIFYGTLIFMYLQPSSSHALDTDKMASVFYTVIIPMLNPLIYSLQNKEVKEALKKIIINKN

SEQ ID NO: 496 - DNA, 945 bp, Homo sapiens
atggccagaaaagatatggctcacatcaattgcacccaggcgacagagtttattcttgtgggcctcacagaccatcaggagttgaagatgcccctctttgtgctattcttatccatctacctcttcacagtggtaggcaacttgggtttgatcctactcattagagcggatacaagtctcaacacaccaatgtacttctttcttagcaacctagcttttgtggatttctgttactcttctgtcattacacccaaaatgcttgggaatttcttgtacaaacaaaatgttatatcctttgatgcatgtgctactcaactgggctgctttctcaccttcatgatatcagaatccttgctactggcttccatggcctatgaccgatatgtggccatttgtaaccctctattgtatatggttgtaatgactccaggaatctgcattcaacttgtagcagttccttatagctatagcttcctaatggcactatttcacaccatcctcaccttccgcctctcctattgccactccaacattgtcaaccatttctattgtgatgacatgcctctcctcaggctaacttgctcagacactcgcttcaaacagctctggatctttgcctgtgctggtatcatgttcatttcctcccttctgattgtctttgtctcctacatgttcatcatttctgccatcctgaggatgcattcagctgagggaagacagaaggctttctcgacgtgtggctctcacatgctggcagtcaccatattctatgggaccctcatttttatgtacttacagcctagctctagccatgccctggacacagacaagatggcctctgtcttctacacagtgatcattcccatgttgaatcccttaatctatagcctccagaataaggaggtgaaagaagctctgaagaaaatcattatcaataaaaactag

SEQ ID NO: 497 - protein, 324 aa, Homo sapiens
MAEVNIIYVTVFILKGITNRPELQAPCFGVFLVIYLVTVLGNLGLITLIKIDTRLHTPMYYFLSHLAFVDLCYSSAITPKMMVNFVVERNTIPFHACATQLGCFLTFMITECFLLASMAYDCYVAICSPLHYSTLMSRRVCIQLVAVPYIYSFLVALFHTVITFRLTYCGPNLINHFYCDDLPFLALSCSDTHMKEILIFAFAGFDMISSSSIVLTSYIFIIAAILRIRSTQGQHKAISTCGSHMVTVTIFYGTLIFMYLQPKSNHSLDTDKMASVFYTVVIPMLNPLIYSLRNKEVKDASKKALDKGCENLQILTFLKIRKLY

SEQ ID NO: 498 - DNA, 975 bp, Homo sapiens
atggctgaagttaatatcatttatgtcactgtattcattctgaaaggaattaccaaccggccagagcttcaggccccgtgctttggggtgtttttagttatctatctggtcacagtgctgggcaatcttgggttgattactttaatcaagattgatactcgactccacacacctatgtactatttcctcagccacctggcctttgttgacctttgttactcctctgctattacaccgaagatgatggtgaattttgttgtggaacgcaacaccattcctttccatgcttgtgcaacccaactgggttgttttctcaccttcatgatcactgagtgtttccttctagcctccatggcctacgattgctatgtcgccatctgtagtcccctgcattattcaacactgatgtcaagaagagtctgcattcaactggtggcagttccatatatatacagcttcctggttgccctcttccacaccgttatcactttccgtctgacttactgtggcccaaacttaattaaccatttctattgtgatgacctccccttcttagctctgtcctgctcagacacacacatgaaggaaattctgatatttgcctttgctggctttgatatgatctcttcctcttccattgtcctcacctcctacatctttattattgccgctatcctaaggatccgctctactcaggggcaacacaaagccatttccacctgtggctcccatatggtgactgtcactattttctatggcacactgatctttatgtacctacagcccaaatcaaatcactccttggacacagacaagatggcttctgtattttacacagtggtgatccccatgttaaaccccctaatctatagtctaaggaacaaagaagtgaaagatgcctcaaagaaagccttggataaaggttgtgaaaacttacagatattaacatttttaaaaataagaaaactttattaa

SEQ ID NO: 499 - protein, 309 aa, Homo sapiens
MKNRTMFGEFILLGLTNQPELQVMIFIFLFLTYMLSILGNLTIITLTLLDPHLQTPMYFFLRNFSFLEISFTSIFIPRFLTSMTTGNKVISFAGCLTQYFFAIFLGATEFYLLASMSYDRYVAICKPLHYLTIMSSRVCIQLVFCSWLGGFLAILPPIILMTQVDFCVSNILNHYYCDYGPLVELACSDTSLLELMVILLAVVTLMVTLVLVTLSYTYIIRTILRIPSAQQRTKAFSTCSSHMIVISLSYGSCMFMYINPSAKEGGAFNKGIAVLITSVTPLLNPFIYTLRNQQVKQAFKDSVKKIVKL

SEQ ID NO: 500 - DNA, 930 bp, Homo sapiens
atgaaaaacagaaccatgtttggtgagtttattctactgggccttacaaatcaacctgaactccaagtgatgatattcatctttctgttcctcacctacatgctaagtatcctaggaaatctgactattatcaccctcaccttactagacccccacctccagacccccatgtatttcttcctccggaatttctccttcttagaaatttccttcacatccatttttattcccagatttctgaccagcatgacaacaggaaataaagttatcagctttgctggctgcttgactcagtatttttttgctatatttcttggagctaccgagttttacctcctggcctccatgtcttatgatcgttatgtggccatctgcaaacccttgcattacctgactattatgagcagcagagtctgcatacaactagtgttctgctcctggttggggggattcctagcaatcttaccaccaatcatcctgatgacccaggtagatttctgtgtctccaacattctgaatcactattactgtgactatgggcctctcgtggagcttgcctgctcagacacaagcctcttagaactgatggtcatcctcttggccgttgtgactctcatggttactctggtgctggtgacactttcttacacatacattatcaggactattctgaggatcccttctgcccagcaaaggacaaaggccttttccacttgttcctcccacatgattgtcatctccctctcttatggcagctgcatgtttatgtacattaatccttctgcaaaagaaggaggtgctttcaacaaaggaatagctgtactcattacttcggttactcccttactgaatcccttcatatatactttaagaaatcagcaagtgaaacaagctttcaaggactcagtcaaaaagattgtgaaactttaa

SEQ ID NO: 501 - protein, 305 aa, Homo sapiens
MEFVFLAYPSCPELHILSFLGVSLVYGLIITGNILIVVSIHTETCLCTSMYYFLGSLSGIEICYTAVVVPHILANTLQSEKTITLLGCATQMAFFIALGSADCFLLAAMAYDRYVAICHPLQYPLLMTLTLCVHLVVASVISGLFLSLQLVAFIFSLPFCQAQGIEHFFCDVPPVMHVVCAQSHIHEQSVLVAAILAIAVPFFLITTSYTFIVAALLKIHSAAGRHRAFSTCSSHLTVVLLQYGCCAFMYLCPSSSYNPKQDRFISLVYTLGTPLLNPLIYALRNSEMKGAVGRVLTRNCLSQNS

SEQ ID NO: 502 - DNA, 918 bp, Homo sapiens
atggaatttgtgttcctggcctatccctcctgcccagaactgcatattctgtccttccttggggtcagcctggtttatggtttgatcatcactgggaacattctcattgtggtgtccattcacacagaaacctgtctatgcacatccatgtactatttcctgggcagcctttctgggattgaaatatgctacactgcagtggtggtgccccatatcctggccaacaccctacagtcagagaagaccatcactctcctgggctgtgccacccagatggctttcttcattgcactgggcagtgctgattgcttcctcttggctgccatggcctatgaccgctatgtggccatttgccacccgttgcagtaccctctcctcatgacattgactctttgtgtccacttggttgtggcatcagtcatcagtggtctgttcctgtccttacaactggtggccttcatcttctctctgccattctgccaggctcagggcattgagcacttcttttgtgatgtgccaccagtcatgcatgttgtttgtgctcagagtcacattcatgagcagtcagtgctggtggcagccatactagccattgctgtgcctttcttcctcatcaccacctcctacaccttcatagtggctgctctgctcaagatccactcggctgctggccgccaccgggccttctccacctgctcttcccacctcactgtggtgctgctgcagtatggctgctgtgccttcatgtacctgtgccccagctccagctacaaccccaagcaagatcggttcatctcactggtgtacacattgggaaccccactgctcaacccacttatctatgccctgaggaacagtgagatgaaaggggccgtagggagagttcttaccaggaactgcctttcccagaacagctag

SEQ ID NO: 503 - protein, 295 aa, Homo sapiens [sequence omitted]

SEQ ID NO: 504 - DNA, 888 bp, Homo sapiens
atggggggctttgggactaacatctcaagtactaccagcttcactctaacaggcttccctgagatgaagggtctggagcactggctggctgcccttctgctgctgctttatgctatttccttcctgggcaacatcctcatcctctttatcataaaggaagagcagagcttgcaccagccaatgtactacttcctgtctcttttttctgttaatgacctgggtgtgtccttttctacattgcccactgtactggctgctgtgtgttttcatgccccagagacaacttttgatgcctgcctggcccagatgttcttcatccacttttcctcctggacagagtttggcatcctactggccatgagttttgaccactatgtggccatctgtaacccgctgcgctatgccacagtgctcactgatgtccgtgtggcccacaatggcatatccattgtcatccgcagcttctgcatggtattcccacttcccttcctcctgaagagactgcctttctgtaaggccagtgtggtactggcccattcctactgtctgcatgcagacctgattcggctgccctggggagacactaccatcaacagcatgtatggcctgttcattgtcatctctgcctttggtgtagattcactgctcatcctcctctcctatgtgctcattctacattctgtgctggccattgcctccaggggtgagaggcttaagacactcaacacatgtgtgtcacatatctatgcagtgctgatcttctatgtgcctatggttagtgtgtccatggttcatcgatttgggaggcatgctcctgaatatgtgcacaagttcatgtctctttgtacctccaatgctctacccaattatctattccatcaagactaa

SEQ ID NO: 505 - protein, 310 aa, Homo sapiens
MDWENCSSLTDFFLLGITNNPEMKVTLFAVFLAVYIINFSANLGMIVLIRMDYQLHTPMYFFLSHLSFCDLCYSTATGPKMLVDLLAKNKSIPFYGCALQFLVFCIFADSECLLLSVMAFDRYKAIINPLLYTVNMSSRVCYLLLTGVYLVGIADALIHMTLAFRLCFCGSNEINHFFCDIPPLLLLSRSDTQVNELVLFTVFGFIELSTISGVFISYCYIILSVLEIHSAEGRFKALSTCTSHLSAVAIFQGTLLFMYFRPSSSYSLDQDKMTSLFYTLVVPMLNPLIYSLRNKDVKEALKKLKNKILF

SEQ ID NO: 506 - DNA, 933 bp, Homo sapiens
atggactgggaaaattgctcctcattaactgatttttttctcttgggaattaccaataacccagagatgaaagtgaccctatttgctgtattcttggctgtttatatcattaatttctcagcaaatcttggaatgatagttttaatcagaatggattaccaacttcacacaccaatgtatttcttcctcagtcatctgtctttctgtgatctctgctattctactgcaactgggcccaagatgctggtagatctacttgccaagaacaagtcaatacccttctatggctgtgctctgcaattcttggtcttctgtatctttgcagattctgagtgtctactgctgtcagtgatggcctttgatcggtacaaggccatcatcaaccccctgctctatacagtcaacatgtctagcagagtgtgctatctactcttgactggggtttatctggtgggaatagcagatgctttgatacatatgacactggccttccgcctatgcttctgtgggtctaatgagattaatcatttcttctgtgatatccctcctctcttattactctctcgctcagatacacaggtcaatgagttagtgttattcaccgtctttggttttattgaactgagtaccatttcaggagttttcatttcttattgttatatcatcctatcagtcttggagatacactctgctgaggggaggttcaaagctctctctacatgcacttcccacttatctgcggttgcaattttccagggaactctgctctttatgtatttccggccaagttcttcctattctctagatcaagataaaatgacctcattgttttacacccttgtggttcccatgttgaaccccctgatttatagcctgaggaacaaggatgtgaaagaggccctgaaaaaactgaaaaataaaattttattttaa

SEQ ID NO: 507 - protein, 312 aa, Homo sapiens
MEVKNCCMVTEFILLGIPHTEGLEMTLFVLFLPFYACTLLGNVSILVAVMSSARLHTPMYFFLGNLSVFDMGFSSVTCPKMLLYLMGLSRLISYKDCVCQLFFFHFLGSIECFLFTVMAYDRFTAICYPLRYTVIMNPRICVALAVGTWLLGCIHSSILTSLTFTLPYCGPNEVDHFFCDIPALLPLACADTSLAQRVSFTNVGLISLVCFLLILLSYTRITISILSIRTTEGRRRAFSTCSAHLIAILCAYGPIITVYLQPTPNPMLGTVVQILMNLVGPMLNPLIYTLRNKEVKTALKTILHRTGHVPES

SEQ ID NO: 508 - DNA, 939 bp, Homo sapiens
atggaggtgaagaactgctgcatggtgacagagttcatccttttgggaatcccacacacagaggggctggagatgacactttttgtcttattcttgcccttctatgcctgcactctactgggaaatgtgtctatccttgttgctgttatgtcttctgctcgccttcacacacctatgtatttcttcctgggaaacttgtctgtgtttgacatgggtttctcctcagtgacttgtcccaaaatgctgctctaccttatggggctgagccgactcatctcctacaaagactgtgtctgccagcttttcttcttccatttcctcgggagcattgagtgcttcttgtttacggtgatggcctatgaccgcttcactgccatctgttatcctctgcgatacacagtcatcatgaacccaaggatctgtgtggccctggctgtgggcacatggctgttagggtgcattcattccagtatcttgacctccctcaccttcaccttgccatactgtggtcccaatgaagtggatcacttcttctgtgacattccagcactgttgcccttggcctgtgctgacacatccttagcccagagggtgagcttcaccaacgttggcctcatatctcttgtctgctttctgctaattcttttatcctacactagaatcacaatatctatcttaagcattcgtacaactgagggccgtcgccgtgccttctccacctgcagtgctcacctcattgccatcctctgtgcctatgggcccatcatcactgtctacctgcagcccacacccaaccccatgctgggaaccgtggtacaaattctcatgaatctggtaggaccaatgctgaaccctttgatctataccttgaggaataaggaagtaaaaacagccctgaaaacaatattgcacaggacaggccatgttcctgagagttag

SEQ ID NO: 509 - protein, 313 aa, Homo sapiens
MPIANDTQFHTSSFLLLGIPGLEDVHIWIGFPFFSVYLIALLGNAAIFFVIQTEQSLHEPMYYCLAMLDSIDLSLSTATIPKMLGIFWFNIKEISFGGYLSQMFFIHFFTVMESIVLVAMAFDRYIAICKPLWYTMILTSKIISLIAGIAVLRSLYMVIPLVFLLLRLPFCGHRIIPHTYCEHMGIARLACASIKVNIMFGLGSISLLLLDVLLIILSHIRILYAVFCLPSWEARLKALNTCGSHIGVILAFSTPAFFSFFTHCFGHDIPQYIHIFLANLYVVVPPTLNPVIYGVRTKHIRETVLRIFFKTDH

SEQ ID NO: 510 - DNA, 942 bp, Homo sapiens
atgcctatagctaacgacacccagttccatacttcttcattcctactgctgggtatcccagggctagaagatgtgcacatctggattggattcccttttttctctgtgtatcttattgcactcctgggaaatgctgctatcttctttgtgatccaaactgagcagagtctccatgagcccatgtactactgcctggccatgttggattccattgacctgagcttgtctacggccaccattcccaaaatgctgggcatcttctggttcaatatcaaggaaatatcttttggaggctacctttctcagatgttcttcatccatttcttcactgtcatggagagcatcgtattggtggccatggcctttgaccgctacattgccatttgcaaacctctttggtacaccatgatcctcaccagcaaaatcatcagcctcattgcaggcattgctgtcctgaggagcttgtacatggtcattccactggtgtttctcctcttaaggttgcccttctgtggacatcgtatcatccctcatacttactgtgagcacatgggcattgcccgtctggcctgtgccagcatcaaagtcaacattatgtttggtcttggcagtatttctctcttgttattggatgtgctccttattattctctcccatatcaggatcctctatgctgtcttctgcctgccctcctgggaagctcgactcaaagctctcaacacctgtggctctcacattggtgttatcttagccttttctacaccagcatttttctctttctttacacactgctttggccatgatattccccaatatatccacattttcttggctaatctatatgtggttgttcctcccaccctcaatcctgtaatctatggggtcagaaccaaacatattagggagacagtgctgaggattttcttcaagacagatcactaa

SEQ ID NO: 511 - protein, 312 aa, Homo sapiens
MALGNHSTITEFLLLGLSADPNIRALLFVLFLGIYLLTIMENLMLLLVIRADSCLHKPMYFFLSHLSFVDLCFSSVIVPKMLENLLSQRKTISVEGCLAQVFFVFVTAGTEACLLSGMAYDRHAAIRRPLLYGQIMGKQLYMHLVWGSWGLGFLDALINVLLAVNMVFCEAKIIHHYSYEMPSLLPLSCSDISRSLIVLLCSTLLHGLGNFLLVFLSYTRIISTILSISSTSGRSKAFSTCSAHLTAVTLYYGSGLLRHLMPNSGSPIELIFSVQYTVVTPMLNSLIYSLKNKEVKVALKRTLEKYLQYTRR

SEQ ID NO: 512 - DNA, 939 bp, Homo sapiens
atggccttggggaatcacagcaccatcaccgagttcctcctccttgggctgtctgccgaccccaacatccgggctctgctctttgtgctgttcctggggatttacctcctgaccataatggaaaacctgatgctgctgctcgtgatcagggctgattcttgtctccataagcccatgtatttcttcctgagtcacctctcttttgttgatctctgcttctcttcagtcattgtgcccaagatgctggagaacctcctgtcacagaggaaaaccatttcagtagagggctgcctggctcaggtcttctttgtgtttgtcactgcagggactgaagcctgccttctctcagggatggcctatgaccgccatgctgccatccgccgcccactactttatggacagatcatgggtaaacagctgtatatgcaccttgtgtggggctcatggggactgggctttctggacgcactcatcaatgtcctcctagctgtaaacatggtcttttgtgaagccaaaatcattcaccactacagctatgagatgccatccctcctccctctgtcctgctctgatatctccagaagcctcatcgttttgctctgctccactctcctacatgggctgggaaacttccttttggtcttcttatcctacacccgtataatctctaccatcctaagcatcagctctacctcgggcagaagcaaggccttctccacctgctctgcccacctcactgcagtgacactttactatggctcaggtttgctccgccatctcatgccaaactcaggttcccccatagagttgatcttctctgtgcagtatactgtagtcactcccatgctgaattccctcatctatagcctgaaaaataaggaagtgaaggtagctctgaaaagaactttggaaaaatatttgcaatataccagacgttga

SEQ ID NO: 513 - protein, 9 aa, Artificial Sequence
  MOD_RES (2): A or G
  MOD_RES (3): Y or F; Description of Artificial Sequence: Synthetic peptide
MXXDRYVAI

SEQ ID NO: 514 - DNA, 20 bp, Artificial Sequence
  Description of Artificial Sequence: Degenerate primer
atggsctwtgaccghtwygt

SEQ ID NO: 515 - protein, 6 aa, Artificial Sequence
  MOD_RES (3): G or A; Description of Artificial Sequence: Synthetic peptide
TCXSHL

SEQ ID NO: 516 - DNA, 17 bp, Artificial Sequence
  modified_base (6): A, T, C or G
  modified_base (9): A, T, C or G
  modified_base (15): A, T, C or G; Description of Artificial Sequence: Degenerate primer
agrtgnswnscrcangt

SEQ ID NO: 517 - DNA, 25 bp, Artificial Sequence
  Description of Artificial Sequence: Degenerate primer
  modified_base (20): A, T, C or G
  modified_base (22)..(23): A, T, C or G
ggggtccggagrsrtadatnanngg

SEQ ID NO: 518 - DNA, 29 bp, Artificial Sequence
  Description of Artificial Sequence: Degenerate primer
  modified_base (16): A, T, C or G
  modified_base (25): A, T, C or G
ggggctgcagacaccnatgtayytnttyy

SEQ ID NO: 519 - DNA, 25 bp, Artificial Sequence
  Description of Artificial Sequence: Degenerate primer
  modified_base (20): A, T, C or G
  modified_base (22)..(23): A, T, C or G
ggggtccggagrstradatnanngg

SEQ ID NO: 520 - DNA, 30 bp, Artificial Sequence
  Description of Artificial Sequence: Degenerate primer
  modified_base (16): A, T, C or G
  modified_base (25): A, T, C or G
ggggctgcagacaccnatgtayytnttyyt

SEQ ID NO: 521 - DNA, 25 bp, Artificial Sequence
  Description of Artificial Sequence: Degenerate primer
  modified_base (20): A, T, C or G
  modified_base (22)..(23): A, T, C or G
ggggtccggagrstradatnanngg

SEQ ID NO: 522 - DNA, 30 bp, Artificial Sequence; identical to SEQ ID NO: 520
  Description of Artificial Sequence: Degenerate primer
  modified_base (16): A, T, C or G
  modified_base (25): A, T, C or G

The invention claimed is:

1. A method for representing sensory perception of one or more odorants comprising:
   (a) providing a representative class of n olfactory receptors or ligand-binding domains thereof;
   (b) measuring $X_1$ to $X_n$ representative of at least one activity of the one or more odorants selected from the group consisting of binding of the one or more odorants to the ligand-binding domain of at least one of the n olfactory receptors, activating at least one of the n olfactory receptors with the one or more odorants, and blocking at least one of the n olfactory receptors with the one or more odorants: and
   (c) generating a representation of sensory perception from the values $X_1$ to $X_n$
   wherein at least one of the n olfactory receptors has the amino acid sequence contained in SEQ ID NO: 55.

2. The method of claim 1, wherein between 5 and 350 olfactory receptors are used in said screening method and said receptors are selected from the amino acid sequences contained in SEQ ID NO:1, SEQ ID NO:3, SEQ ID NO:5, SEQ ID NO:7, SEQ ID NO:9, SEQ ID NO: 11, SEQ ID NO:13, SEQ ID NO:15, SEQ ID NO: 17, SEQ ID NO:19, SEQ ID NO:21, SEQ ID NO:23, SEQ ID NO:25, SEQ ID NO:27, SEQ ID NO: 29, SEQ ID NO: 31, SEQ ID NO:33, SEQ ID: 35, SEQ ID NO:37, SEQ ID NO: 39, SEQ ID NO:41, SEQ ID NO: 43, SEQ ID NO:45, SEQ ID NO:47, SEQ ID NO:49, SEQ ID NO:51, SEQ ID NO:53, SEQ ID NO: 55, SEQ ID: NO: 57, SEQ ID NO:59, SEQ ID NO:61, SEQ ID NO:63, SEQ ID NO: 65, SEQ ID NO 67, SEQ ID NO:69, SEQ ID NO:71, SEQ ID NO 73, SEQ ID NO:75, SEQ ID NO: 77, SEQ ID NO: 79, SEQ ID NO:81, SEQ ID NO:83, SEQ ID NO:85, SEQ ID NO: 87, SEQ ID NO:89, SEQ ID NO:91, SEQ ID NO:93, SEQ ID NO:95, SEQ ID NO:97, SEQ ID NO:99, SEQ ID NO: 101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO :197 SEQ ID NO:199, SEQ ID NO:201, SEQ ID NO: 203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO0415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ. ID NO:501, SEQ ID NO:503, SEQ ID NO:505, SEQ ID NO:507, SEQ ID NO:509, and SEQ ID NO:511.

3. The method of claim 1 wherein at least two different activities are measured to provide the values $X_1$ to $X_n$.

4. The method of claim 1 wherein said odorant receptor is expressed in cells and the cells expressing each odorant receptor are located at an identifiable position.

5. The method of claim 1 wherein said at least one olfactory receptor is soluble and binding of said odorant to a ligand-binding domain of the soluble olfactory receptor is measured in solution.

6. The method of claim 1 wherein said at least one olfactory receptor is in solid state and binding of odorant to a ligand-binding domain of the solid-state olfactory receptor is measured on a substrate.

7. The method of claim 1 wherein the value measured for binding is above a preset limit for specific binding to olfactory receptors.

8. The method of claim 1 wherein the value measured for activating said receptor is derived from a signal selected from the group consisting of intracellular $Ca^{2+}$, cAMP, cGMP and IP3.

9. The method of claim 1 wherein the value measured for activating an olfactory receptor is above a preset limit for specific activation.

10. The method of claim 1 wherein the value measured for blocking an olfactory receptor is at least a reduction in binding of the odorant or activation by the odorant.

11. The method of claim 1 wherein the representation of sensory perception is generated with a neural network.

12. The method of claim 2 which comprises using at least 50 of said olfactory sequences.

13. The method of claim 1 which comprises using at least 100 of said olfactory sequences.

14. The method of claim 1 which comprises using at least 200 of said olfactory sequences.

* * * * *